US012473572B1

(12) United States Patent
Calderón Mayo et al.

(10) Patent No.: US 12,473,572 B1
(45) Date of Patent: Nov. 18, 2025

(54) ***GALLID ALPHAHERPESVIRUS* 3 (MDV-2), A VIRAL VECTOR AGAINST DIFFERENT AVIAN PATHOGENS: A NEW VACCINATION STRATEGY IN THE POULTRY INDUSTRY**

(71) Applicant: FARMACOLÓGICOS VETERINARIOS S.A.C., Ica (PE)

(72) Inventors: Katherine Ivette Calderón Mayo, Chincha Alta (PE); Aldo Stanlee Rojas Neyra, Chincha Alta (PE); Manolo Clemente Fernández Díaz, Chincha Alta (PE)

(73) Assignee: FARMACOLÓGICOS VETERINARIOS S.A.C., ICA (PE)

( * ) Notice: Subject to any disclaimer, the term of this patent is extended or adjusted under 35 U.S.C. 154(b) by 0 days.

(21) Appl. No.: 18/938,932

(22) Filed: Nov. 6, 2024

(30) Foreign Application Priority Data

Jun. 28, 2024 (PE) ........................ 001508-2024/DIN

(51) Int. Cl.

| | |
|---|---|
| ***C12N 9/22*** | (2006.01) |
| ***A61P 31/14*** | (2006.01) |
| ***A61P 37/04*** | (2006.01) |
| ***C07K 14/005*** | (2006.01) |
| ***C12N 15/113*** | (2010.01) |
| ***C12N 15/86*** | (2006.01) |
| *A61K 39/00* | (2006.01) |

(52) U.S. Cl.
CPC .............. *C12N 15/86* (2013.01); *A61P 37/04* (2018.01); *C07K 14/005* (2013.01); *A61K 2039/5256* (2013.01); *C12N 2710/00034* (2013.01); *C12N 2710/16343* (2013.01); *C12N 2720/10034* (2013.01); *C12N 2760/18122* (2013.01); *C12N 2760/18134* (2013.01)

(58) Field of Classification Search
CPC .......... A61P 31/14; A61P 31/16; A61P 31/20; C12N 2310/20; C12N 15/1131
See application file for complete search history.

(56) References Cited

U.S. PATENT DOCUMENTS

2020/0323978 A1 10/2020 Cook et al.

FOREIGN PATENT DOCUMENTS

| | | |
|---|---|---|
| EP 3391903 | | 2/2022 |
| ES 2719409 | | 7/2019 |
| WO | WO 2018/193110 | 10/2018 |
| WO | WO 2022/136623 | 6/2022 |

OTHER PUBLICATIONS

Kim et al., "Vaccinal efficacy of melcularly cloned Gallid alphaherpesvirus 3 strain 301B/1 against very virulent Marek's disease virus challenged", Journal of General Virology, 2020, 101(5);Abstract.*

Baron et al. "Recent advances in viral vectors in veterinary vaccinology," Current Opinion in Virology, 2018, vol. 29, pp. 1-7.

Calderon et al. "A Recombinant Turkey Herpesvirus Expressing the F Protein of Newcastle Disease Virus Genotype XII Generated by NHEJ-CRISPR/Cas9 and Cre-LoxP Systems Confers Protection against Genotype XII Challenge in Chickens, " Viruses, 2022, vol. 14, p. 793.

Chumbe et al. "Characterization and Sequencing of a Genotype XII Newcastle Disease Virus Isolated from a Peacock ( Pavo cristatus ) in Peru," Genome Announcements, 2015, vol. 3, No. 4, article e00792-15.

Hein et al. "Review of Poultry Recombinant Vector Vaccines," Avian Diseases, 2021, vol. 65, pp. 438-452.

IQBAL "Progress toward the development of polyvalent vaccination strategies against multiple viral infections in Chickens using herpesvirus of turkeys as vector," Bioengineered, 2012, vol. 3, pp. 222-226.

Jarosinski et al. "Marek's disease virus: Lytic replication, oncogenesis and control," Expert Review of Vaccines, 2006, vol. 5, pp. 761-772.

Kim et al. "Vaccinal efficacy of molecularly cloned Gallid alphaherpesvirus 3 strain 301B/1 against very virulent Marek's disease virus challenge," Journal of General Virology, 2020, vol. 101, pp. 542-552.

Petherbridge et al. "Cloning of Gallid herpesvirus 3 (Marek's disease virus serotype-2) genome as infectious bacterial artificial chromosomes for analysis of viral gene functions," Journal of Virological Methods, 2009, vol. 158, pp. 11-17.

Ran et al. "Genome engineering using the CRISPR-Cas9 system," Nature Protocols, 2013, vol. 8, pp. 2281-2308.

Romanutti et al. "Current status of virus-vectored vaccines against pathogens that affect poultry," Vaccine, 2020, vol. 38, pp. 6990-7001.

Sadigh et al. "Gallid herpesvirus 3 SB-1 strain as a recombinant viral vector for poultry vaccination," NPJ Vaccines, 2018, vol. 3, pp. 1-7.

Salsman et al. "Precision genome editing in the CRISPR era," Biochemistry and Cell Biology, Apr. 2017, vol. 95, No. 2, pp. 187-201.

Suenaga et al. "Engineering large viral DNA genomes using the CRISPR-Cas9 system," Microbiology and Immunology, Sep. 2014, vol. 58, No. 9, pp. 513-522.

* cited by examiner

*Primary Examiner* — Barry A Chestnut
(74) *Attorney, Agent, or Firm* — Sheridan Ross P.C.

(57) ABSTRACT

The present invention refers in general to the field of veterinary medicine and especially to the development of vectored vaccines using the *Gallid alphaherpesvirus* 3 (GaHV-3) or Marek's disease serotype 2 (MDV-2) vector, which contains protective antigens against different avian pathogens such as Newcastle disease virus (NDV), avian infectious laryngotracheitis virus (ILTV), infectious bursal disease virus (IBDV) or Gumboro disease virus, avian influenza virus (AIV), infectious bronchitis virus (IBV).

15 Claims, 17 Drawing Sheets

Specification includes a Sequence Listing.

EXPERIMENT NO. 1 ON SPF BIRDS

EXPERIMENT NO. 2 ON BROILERS

A)

*GALLID ALPHAHERPESVIRUS* 3 (MDV-2), A VIRAL VECTOR AGAINST DIFFERENT AVIAN PATHOGENS: A NEW VACCINATION STRATEGY IN THE POULTRY INDUSTRY

CROSS REFERENCE TO RELATED APPLICATIONS

This application claims the benefit of Peru Application No. 001508-2024/DIN filed Jun. 28, 2024, the entire contents of which are incorporated herein by reference in its entirety.

REFERENCE TO SEQUENCE LISTING

This application contains a Sequence Listing submitted as an electronic text file named "Gallid-Alphaherpesvirus-3_MDV-2_SECUENCIAS_revised.xml", having a size in bytes of 1,208 KB, and created on 18 Feb. 2025. The information contained in this electronic file is hereby incorporated by reference in its entirety pursuant to 37 CFR § 1.77(b)(5)(ii).

SUMMARY

The present invention refers in general to the field of veterinary medicine and especially to the development of vectored vaccines using the *Gallid alphaherpesvirus* 3 (GaHV-3) or Marek's disease serotype 2 (MDV-2) vector, which contains protective antigens against different avian pathogens such as Newcastle disease virus (NDV), avian infectious laryngotracheitis virus (ILTV), infectious bursal disease virus (IBDV) or Gumboro disease virus, avian influenza virus (AIV), infectious bronchitis virus (IBV).

FIELD OF INVENTION

The invention describes the obtaining of new vectorized vaccines with the insertion and expression of different genes and/or protective antigens against different viral pathogens. The present invention describes the procedure for obtaining new recombinant and/or vectorized vaccines based on the *Gallid alphaherpesvirus* 3 (GaHV-3) or Marek's disease serotype 2 (MDV-2) vector, as well as the process for selecting recombinant clones with great stability, expression and immunogenicity.

Among the genes of interest in the invention are; the fusion gene (F) of Newcastle disease virus (NDV) genotype XII, or at least one other hemagglutinin neuraminidase (HN) gene of genotype XII, I, II, and/or VII, or the glycoproteins D and I (gD-I) of avian infectious laryngotracheitis (ILTV) or at least one gene of the following genes gB, gE, and gC., the VP2 protein of Gumboro infectious disease (IBDV) or at least one gene of the following genes VP3, VP4 and VPx of IBDV, the hemagglutinin (HA) and neuraminidase (NA) gene of H5N1, H5N9, $H_xN_x$ of avian influenza (AIV), avian infectious bronchitis (IBV) at least one Spike (S) gene, S1, and S2.

DESCRIPTION OF RELATED TECHNIQUE

Marek's disease virus (MDV) or *Gallid alphaherpesvirus* 2 (GaHV-2), is the etiologic agent of Marek's disease, it is an alphaherpesvirus that affects avian species (*Gallus gallus domesticus*) where it is established as a chronic infection. Marek's disease (MD), is characterized based on its immunosuppression, neurological disorders, neoplastic disorders of $CD4^+$ cells, located around the peripheral nerve and visceral organs of the host (1).

MDV is a ubiquitous virus in the commercial poultry industry worldwide that is controlled primarily through the use of vaccines. Significant losses prior to the use of vaccines precluded the possibility of raising broilers in confinement. Currently, all North and South American hens, both laying and broilers, are vaccinated against MD disease as a mandatory condition (1).

In the last 40 years, live vaccines of different strains are used in different combinations for MD control (2-4). Of which these include; the naturally attenuated vaccine Marek serotype 1 (MDV-1) strain Rispens (CVI-988), Marek serotype 2 (MDV-2) *Gallid alphaherpesvirus* 3 (GaHV-3) including strains: SB-1, 3011B/1, and HPRS24, and the turkey herpesvirus (HVT) Meleagrid herpesvirus 1 (MeAHV-1) strain Fc126. Of which the most commonly used is the strain SB-1 and MeHV-1 strain Fc126, because in combination they present an apparent additive effect in the protection of chicks against virulent strains of MDV (5).

*Gallid alphaherpesvirus* 3 (GaHV-3) belongs to the family Herpesviridae, subfamily Alphaherpesvirinae, genus Mardivirus. According to the International Committee on Taxonomy of Viruses (ICTV), the genus Mardivirus is classified into three species: *Gallid alphaherpesvirus* 2, *Gallid alphaherpesvirus* 3 (non-oncogenic strains: SB-1, 3011B/1, and HPRS-24), and Meleagrid herpesvirus 1, and formally known as: MDV serotype 1 (MDV-1), MDV serotype 2 (MDV-2), and MDV serotype 3 (MDV-3), respectively.

Additionally, the advantages of these vaccines are successful due to their long-term protection against MD, these herpesvirus vaccine strains have been recognized as recombinant viral vectors including protection against a number of avian viral pathogens, such as: Gumboro disease (IBD), avian influenza (AI), avian infectious laryngotracheitis (ILT), Newcastle disease (ND), etc. (6-9).

Although the HVT vaccine vector provides extremely effective protection, that is, these vaccines used individually have proven to be extremely effective; however, when more than one HVT vector vaccine is used, the opposite occurs, that is, problematic results are obtained in obtaining the desired immune response against each vaccine used in combination.

There are clear recommendations not to use the HVT vector with recombinant vectors, due to the result of possible interference, generating poor efficacy against foreign inserts. Therefore, with these restrictions on the HVT vector due to its use as a multivalent vaccine, there is a need to develop other vectored vaccine platforms, which would greatly complement this interference with protection against multiple vaccine components.

Alphaherpesviruses have a double-stranded DNA genome of approximately 178 kilo base pairs (kbp), of which it contains several non-essential regions for its replication, such as 10 genes in the US (unique short) region and 23 genes in the UL (unique long) region, thus allowing them to be integrated or replaced by other genes from other pathogens. Specifically, the US7, UL40 genes and UL45-46 intergenic regions of the HVT genome, and the US2 and UL41 genes of the MDV genome, tend to be used as insertion sites. Recently, a comparative study of non-essential genes has shown that US2 is more effective at expressing heterologous genes than the US10 insertion site (6).

Promoters commonly used to obtain viral vectors based on alphaherpesviruses are those of cytomegalovirus, simian virus 40, and chicken b-actin, as well as some MDV promoters (unidirectional or bidirectional), which have been successful.

The technology for obtaining MDV and HVT recombinants involves plasmids, bacmids, and fosmids.

Although these techniques allow the insertion of protective genes against other avian pathogens, these strategies have limitations and tend to be time-consuming to obtain vaccines (10).

Clustered Regularly Interspaced Short Palindromic Repeat (CRISPR)/Cas is a new gene editing system that derives from the same immune system of bacteria, which allows them to remember and destroy phages as a defense tool against viral invasions (11).

CRISPR associated to Cas 9 (CRISPR/Cas9) type II system, consisting of a guide RNA that is guided by the *Streptococcus pyogenes* Cas9 endonuclease, and which consists of: a single guide RNA (gRNA) and trans-activating crRNA (tracrRNA), has recently been developed for eukaryotic cell editing by precisely and efficiently introducing a double break in the double-stranded deoxyribonucleic acid (DNA). These double-stranded breaks (DSBs) are subsequently repaired by nonhomologous end joining (NHEJ), which repairs the DNA causing the presence of indels in the region (e.g., insertions or deletions), or by homology directed repair (HDR), which repairs the DNA in the presence of a donor homologous to the DNA. CRISPR/Cas9 is a system that has proven to be a powerful genetic tool that is currently adapted to the editing of viruses whose genomes contain DNA such as Epstein-Barr virus, pseudorabies virus and herpes simplex virus type I. CRISPR/Cas9 technology has recently been applied to avian herpesvirus (12).

From the point of view of patent documents, WO2022/136623 is known which refers to recombinant HVT constructs (rHVT), useful as a multivalent vaccine vector for birds. The rHVT comprises 4 heterologous genes from avian pathogens: the VP2 gene of IBDV, the F gene of NDV and the gD and gI genes of ILTV. The VP2 and F genes are inserted into the US genome region of the rHVT. The gD-gI genes are inserted into the UL genome region, either between UL44 and UL45, or between UL45 and UL46 of the rHVT genome. The rHVTs proved to be genetically stable in vitro and in vivo, and expressed all inserted genes well enough to induce protective immunity in birds vaccinated against IBDV, NDV and ILTV. The integration of expression cassettes is performed using CRISPR/Cas9.

In turn, document ES2719409 teaches a composition or vaccine for use in a procedure for inducing an immunogenic or protective response in an animal against one or more avian pathogens, said composition or vaccine comprising a vector of recombinant gallinaceous herpesvirus 3 (MDV-2) SB-1 strain, said vector comprising one or more heterologous polynucleotides encoding and expressing at least one antigen of an avian pathogen, wherein the heterologous polynucleotide encodes the NDV-F Newcastle disease virus protein. The heterologous polynucleotide is an NDV-F VIId polynucleotide that is codon-optimized, the promoter is an SV40 promoter and a polyadenylation signal, wherein the heterologous polynucleotide encoding NDV-F is inserted into the region between ORF UL55 and ORF LORF5 in the unique long (UL) region of the *Gallid herpesvirus* 3 (MDV-2) SB-1 strain vector; or the heterologous polynucleotide is a codon-optimized NDV-F VIId polynucleotide, the promoter is an SV40 promoter and the polyadenylation signal is endogenous originating from the glycoprotein C (gC) gene, additionally, wherein the heterologous polynucleotide encoding NDV-F is inserted into the region encoding glycoprotein C (UL44) of the *Gallid herpesvirus* 3 (MDV-2) SB-1 strain vector. The genes encoding the antigen or polypeptide described in the invention may be those encoding the fusion protein of the Newcastle disease virus (NDV-F), the hemagglutinin neuraminidase of the Newcastle disease virus (NDV-HN), among others.

Also known is document EP3391903 which refers to a recombinant vector of *Gallid herpesvirus* 3 (GaHV3; MDV-2) comprising one or more heterologous polynucleotides encoding and expressing at least one antigen of an avian pathogen, inserted into the intergenic regions UL3/UL4 and/or UL21/UL22 of the *Gallid herpesvirus* 3 vector. Preferably, the recombinant *Gallid herpesvirus* 3 vector is a vector of the recombinant *Gallid herpesvirus* 3 strain SB-1. Preferably, the at least one antigen protects against infectious bursal disease virus (IBDV), infectious laryngotracheitis virus (ILTV), Newcastle disease virus (NDV), avian influenza virus (AIV) or avian infectious bronchitis virus (IBV). The at least one antigen may be selected from the group consisting of (a) VP2, VP3, VP4 and VPX of infectious bursal disease virus (IBDV); (b) glycoprotein B, glycoprotein I, glycoprotein D, glycoprotein E and glycoprotein C of ILTV; (c) fusion protein of Newcastle disease virus (NDV-F) and viral hemagglutinin neuraminidase (NDV-NH) of NDV (d) hemagglutinin (HA) and neuraminidase (NA) of avian influenza. The *Gallid herpesvirus* 3 vector contains an expression cassette further comprising a promoter such as cytomegalovirus (CMV) and SV40 promoter.

In turn, document US2020/0323978 describes recombinant multivalent non-pathogenic Marek's disease virus constructs that encode and express foreign antigens from three or more avian viruses and methods of using multivalent avian virus vaccines. Recombinant non-pathogenic Marek's disease virus (rMDVnp) vectors (including HVT vectors) that encode and express antigens from three or more foreign pathogens of chicken viruses are provided. The rMDVnp vector encodes one or more antigens from the laryngotracheitis virus (ILTV), one or more antigens from the infectious bursal disease virus (IBDV), and one or more antigens from the Newcastle disease virus (NDV).

Document WO2018/193110 is also known, which is directed to a recombinant *Gallid herpesvirus* 3 vector encoding heterologous avian pathogen antigens comprising one or more heterologous polynucleotides inserted into the UL3/UL4 and/or UL21/UL22 intergenic sites. Additional methods for treating an avian species for protection against one or more diseases caused by avian pathogens and a method for producing the recombinant *Gallid herpesvirus* 3 vector encoding heterologous avian pathogen antigens are provided. The recombinant viral vector may have a polynucleotide encoding a viral protein or gene product of avian influenza virus (AIV), such as an HA or NA protein or gene product of AIV and fusion protein of Newcastle disease virus (NDV-F) and viral neuraminidase hemagglutinin (NDV-NH) of NDV.

In this sense, it is clear that there is an unmet need to obtain a *Gallid alphaherpesvirus* 3 as a modified recombinant vector for the insertion of the F and HN genes of NDV, gD-I, gB of ILTV, VP2 of IBDV, HA and NA of AIV, and Spike (S), S1, S2 of IBV under the control of a promoter and a terminator, which demonstrates an early immune response by serology and complete protection in SPF hens and broilers against NDV, ILTV, IBDV, AIV, IBV and a complete reduction of viral shedding in cloacal and tracheal swabs.

DETAILED DESCRIPTION OF THE INVENTION

Figure 1:
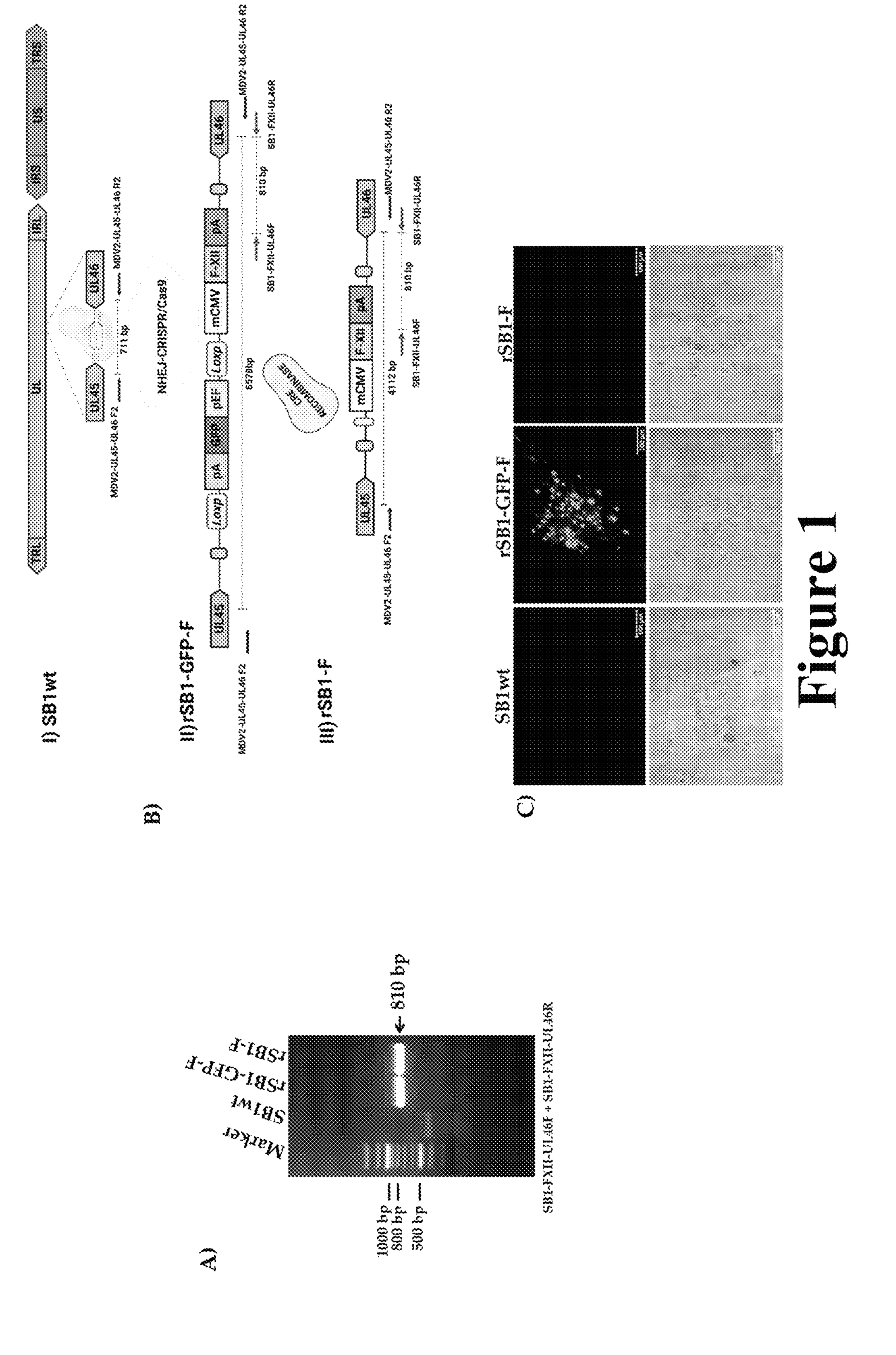
FIG. 1 shows the strategy used for the generation of the rSB1-F virus by CRISPR/Cas9-NHEJ technology. (A) Correct confirmation of insertion of the NDV genotype XII F gene into the genome of rSB1-GFP-F and rSB1-F was demonstrated using specific primers. (B) The parental virus genome, or SB1wt, is shown with a unique long (UL) region, unique short region (US), and long (TRL/IRL) and short (TRS/IRS) internal repeat regions. Strategy used for the generation of rSB1-F by CRISPR/Cas9-NHEJ. This figure was created with BioRender.com (Figure not scaled). (C) Comparison of lysis plaque morphology of SB1wt, rSB1-GFP-F, and rSB1-F in bright field and fluorescence.
Figure 2:
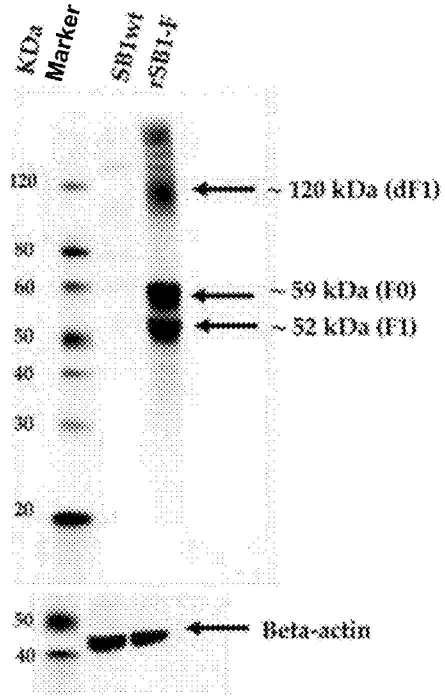
FIG. 2 shows the expression of the NDV F protein in rSB1-F at passage 20. F protein expression was assessed in CEF cells infected with rSB1-F by Western blot, where we detected a band of ~52 kDa corresponding to the subunit (F1), a band of ~59 kDa corresponding to the inactive precursor (F0) and finally a band of ~120 kDa corresponding to the F1 dimer (dF1) of the F protein. Beta-actin (β-actin) was detected as a run control and CEF cells infected with SB1wt were used as a negative control for the experiment, in which no bands were detected.

The present invention is framed within the veterinary pharmaceutical industry and relates to recombinant molecular biology methods for the development of immunogenic products for use in animals, such as birds. In particular, the present invention relates to the field of preventive veterinary medicine.

In one embodiment, the invention comprises a recombinant *Gallid alphaherpesvirus* 3 (GaHV-3, MDV-2), expressing the fusion gene (F) of Newcastle disease virus (NDV) genotype XII comprising the identification sequence SEQ. ID. NO. 4.

In a further embodiment, the invention comprises a recombinant *Gallid alphaherpesvirus* 3 (GaHV-3, MDV-2) virus expressing the fusion gene (F) of Newcastle disease virus (NDV) genotype XII wherein the fusion gene (F) insertion is inserted into the non-coding intergenic region between UL45/46 of the genome of *Gallid alphaherpesvirus* 3 (GaHV-3, MDV-2) non-oncogenic strains: SB-1 (SEQ. ID. NO. 1), 301B/1, and HPRS-24.

In a further embodiment, the invention comprises a recombinant *Gallid alphaherpesvirus* 3 (GaHV-3, MDV-2) virus, which expresses the fusion gene (F) of Newcastle disease virus (NDV) genotype XII wherein the cleavage site has been modified from polybasic ($^{112}$RRQKRF$^{117}$) to dibasic ($^{112}$GRQGRL$^{117}$).

In a further embodiment, the invention comprises a recombinant *Gallid alphaherpesvirus* 3 (GaHV-3, MDV-2) virus, which expresses the fusion gene (F) of Newcastle disease virus (NDV) genotype XII according to claim 1 wherein the synthetic sequence of the F cassette is stored in the plasmid pUC57-F In a further embodiment, the invention comprises an immunogenic composition comprising recombinant *Gallid alphaherpesvirus* 3 (GaHV3; MDV-2) virus, expressing the F gene of NDV genotype XII identified with SEQ ID NO. 5 and pharmaceutically acceptable excipients.

In a further embodiment, the invention comprises an immunogenic composition comprising the recombinant *Gallid alphaherpesvirus* 3 (GaHV3; MDV-2) virus, which expresses glycoproteins D and I of ILTV strain VFAR-043 identified with SEQ ID NO.22 and pharmaceutically acceptable excipients.

In a further embodiment, the invention comprises an immunogenic composition comprising recombinant *Gallid alphaherpesvirus* 3 (GaHV3; MDV-2) virus, expressing the VP2 gene of IBDV strain Faragher 52/70, identified with SEQ ID NO. 36 and pharmaceutically acceptable excipients.

In a further embodiment, the invention comprises a recombinant *Gallid alphaherpesvirus* 3 (GaHV3; MDV-2) virus expressing the fusion gene (F) of Newcastle disease virus (NDV) genotype XII wherein the synthetic sequence of the F cassette (genotype XII) is stored in the plasmid pUC57-F, the sequence of the F cassette and HN of NDV may vary or be obtained from other strains; Clone 30, LaSota, and B1, which may belong to genotype I, II, and VII.

In another further embodiment, the invention comprises a process for generating a recombinant virus of *Gallid alphaherpesvirus* 3 (GaHV3; MDV-2), which expresses antigenic genes against different avian diseases NDV, ILTV, IBDV, IBV and AIV, wherein the process comprises:

a) Design and construction of the gRNAs and the donor plasmid;
b) Generation of recombinants;

c) Recovery of the recombinant viruses;

e) Selection and characterization of the recombinant viruses that contain the GFP cassette+the cassette of interest (protective antigen), by conventional PCR amplifying the inserted complete cassette and the joining zones between the genome of the recombinant virus obtained and the genome of the modified virus itself;

f) Removal of the expression cassette of the fluorescent reporter gene "GFP" by the Cre-Lox system and selection of recombinant clones using conventional PCR;

g) Detection of expression of proteins of interest in cells infected with recombinant viruses by indirect immunofluorescence (IIF);

h) Determination of gene expression by Western blot (WB);

i) Evaluation of genetic stability of the cassette inserted in the virus genome by conventional PCR and/or Western blot (WB); and j) Measurement of in vitro growth properties.

In another further embodiment, the invention comprises a kit comprising a vaccine or immunogenic composition and a medium which may be a bag containing a nutrient medium named DMEM as a sterile diluent and which may be refrigerated at 4° C.

In another further embodiment, the invention comprises a vaccine comprising the recombinant *Gallid alphaherpesvirus* 3 (GaHV-3; MDV-2) virus wherein the concentration of virus required to achieve the antigenic response is 3000 plaque-forming units per bird (PFU/bird).

In another further embodiment, the invention comprises a viral vector comprising a recombinant *Gallid alphaherpesvirus* 3 (GaHV-3; MDV-2) virus according to the invention, useful in the control against Newcastle disease virus (NDV), against infectious bursal disease virus or Gumboro (IBDV), against avian infectious bronchitis virus (IBV), against avian infectious laryngotracheitis virus (ILTV) and against avian influenza virus (AIV).

In another further embodiment, the invention comprises a vaccine comprising the recombinant *Gallid alphaherpesvirus* 3 (GaHV-3; MDV-2) according to the invention, wherein the *Gallid alphaherpesvirus* 3 (GaHV3; MDV-2) is selected from non-oncogenic strains: SB-1, 301B/1, and HPRS-24.

Example 1

Construction, immunogenicity, and protective efficacy of *Gallid alphaherpesvirus* 3 (GaHV-3) efficiently expressing the Newcastle disease virus (NDV) genotype XII fusion gene in SPF birds and broilers.

I. Methodology

Animals

Specific pathogen-free (SPF) 1-day-old White Leghorn hens (Charles River Avian Vaccine Services, Norwich, USA) (Experiment No. 1) and 1-day-old broilers (Experiment No. 2).

Cells and Viruses

For the generation and maintenance of the recombinant virus rSB1-F, chick embryo fibroblast (CEF) cells harvested from 9-10-day old pathogen-free (SPF) embryonated eggs (Charles River Avian Vaccine Services, Norwich, USA) were used. CEFs cells were maintained in Dulbecco's Modified Eagle medium/F12 (DMEM, Thermo Fisher Scientific) supplemented with 5% inactivated fetal bovine serum (FBS, Thermo Fisher Scientific) and 1× antibiotic-antimycotic (Thermo Fisher Scientific), at 37° C., under 5% $CO_2$ atmosphere.

*Gallid alphaherpesvirus* 3 (GaHV3) virus or MDV-2 (MDV serotype 2) strain SB1 (GenBank accession no.: HQ840738.1) (SEQ ID NO.1) was used for the generation of recombinant rSB1-F virus in CEFs cells by CRISPR/Cas9 technology and the NHEJ repair pathway.

The NDV challenge strain known as NDV/peacock/Peru/2011 (PP2011) (GenBank accession no. KR732614) belonging to class II genotype XII with an intracerebral pathogenicity index (ICPI) of 1.80 with characteristics of a velogenic pathotype, was previously isolated and characterized in Peru.

Design and Construction

The recombinant virus rSB1-F was obtained by CRISPR/Cas9-NHEJ technology using the plasmids and sgRNAs: pGEM-sgA-GFP-F, px459v2.0-sgRNA-sgA, and px459v2.0-sgRNA1-SB1/UL45-46, px459v2.0-sgRNA2-SB1/UL45-46, px459v2.0-sgRNA3-SB1/UL45-46, px459v2.0-sgRNA4-SB1/UL45-46.

Design and Construction of sgRNAs and Donor Plasmid

Selection and Design of sgRNAs

The target sequence in this invention was the intergenic region of the UL45 and UL46 genes of the *Gallid alphaherpesvirus* 3 genome, which was submitted for gRNA design (http://crispr.mit.edu/), thus selecting 4 sequences with the highest score. The sequences are shown in Table 1.

Plasmid px459v2.0 (catalog no. 62988; Addgene, USA) was digested with BbsI-HF (Neb New England BioLabs, Inc) and then purified using the QIAquick Gel Extraction Kit (Qiagen) following the manufacturer's instructions.

sgRNAs were presented as oligo-DNA primers corresponding to the sgRNA of the target sequence were synthesized and cloned into the previously digested px459v2.0 cloning vector for the construction of px459v2.0-sgRNA. The sequence of sg-A was taken from a previous publication and cloned into the px459v2.0 plasmid in the same way. The correct insertion of the sgRNAs was confirmed by digestion with the enzyme BbsI-HF (data not shown).

Sequence of the non-coding intergenic region between UL45/46 of the *Gallid alphaherpesvirus* 3 (strain SB1) genome (SEQ ID NO.2)

```
Size: 119 bp
>acgcgagagaccgagcattagagtagcacttatttattctatcgcagag

aaacaccgcgcgcgttcaaaaaaaacacaggcggggtacgataaatttac

gcggccgcgctatgtttact
```

TABLE 1

Sequences of sgRNAs designed based on the 119 bp sequence of the UL45/46 intergenic region of the *Gallid alphaherpesvirus* 3 (strain SB1) genome (GenBank accession no.: HQ840738.1) https://www.ncbi.nlm.nih.gov/nuccore/HQ840738.1.

| # | sgRNA | 5'----------------------------3' | |
|---|---|---|---|
| 1 | gRNA1_UL45/46/SB1_T | CACCGGCGCGTTCAAAAAAAACAC | gT(+) |
| | gRNA1_UL45/46/SB1_B | AAACGTGTTTTTTTTGAACGCGCC | gB(-) |

TABLE 1-continued

| Sequences of sgRNAs designed based on the 119 bp sequence of the UL45/46 intergenic region of the *Gallid alphaherpesvirus* 3 (strain SB1) genome (GenBank accession no.: HQ840738.1) https://www.ncbi.nlm.nih.gov/nuccore/HQ840738.1. | | | |
|---|---|---|---|
| # | sgRNA | 5'----------------------------3' | |
| 2 | gRNA2_UL45/46/SB1_T | CACCGGTTCAAAAAAAACACAGGC | gT(+) |
| | gRNA2_UL45/46/SB1_B | AAACGCCTGTGTTTTTTTTGAACC | gB(−) |
| 3 | gRNA3_UL45/46/SB1_T | CACCGGGGGTACGATAAATTTACG | gT(+) |
| | gRNA3_UL45/46/SB1_B | AACCGTAAATTTATCGTACCCCC | gB(−) |
| 4 | gRNA4_UL45/46/SB1_T | CACCGTGTTTTTTTTGAACGCGCG | gT(+) |
| | gRNA4_UL45/46/SB1_B | AAACCGCGCGTTCAAAAAAAACAC | gB(−) |

B = Lower DNA chain, T= Upper DNA chain sgRNAs cloning procedure

Hybridization of sgRNAs

The sgRNA was synthesized as oligo:

5'CACCNNNNNNNNNNNNNNNNNNNNNNNNNNNNNNNNNNNNNNNNCAAA 5'

*The sgRNA was resuspended in nuclease-free water and diluted 1/10 to have a final working concentration of 10 μM.

| 1× hybridization reaction: | |
|---|---|
| Hybridization reaction | Volume |
| Hybridization buffer solution 1x | 2 μl |
| sgRNA upper DNA chain (10 μM) | 2 μl |
| sgRNA lower DNA chain (10 μM) | 2 μl |
| $H_2O$ | 14 μl |
| TOTAL | 20 μl |

*Hybridization buffer solution: 10 mM Tris, pH 7.5-8; 50 mM NaCl, 1 mM EDTA.

The samples were placed in the thermocycler under the following conditions:

90° C. for 3 min and 37° C. for 1 hour

The samples were quantified by spectrophotometry using Eppendorf BioPhotometer plus, obtaining an average value of 200 ng/μl. A 1/10 dilution was performed to have a working stock of 20 ng/μl.

Digestion or Linearization of the Plasmid Vector pX459-v2.0 (Catalog No. 62988; Addgene, USA)

| Digestion reaction 1×: | | |
|---|---|---|
| Digestion reaction | Reaction 1× | Volume |
| CutSmart Buffer Solution 10× | 1× | 2 μl |
| BbS I-HF enzyme (20 000 U) | 20 units | 1 μl |
| Plasmid (500 ng/ml) | 2 μg | 4 μl |
| $H_2O$ | | 12 μl |
| TOTAL | | 20 μl |

Samples were placed in the thermocycler at 37° C. for 6 hours.

An electrophoresis assay was performed in order to purify the band of interest, which contains the linear DNA. The gel was cut and the DNA was extracted using the QIAquick® Gel Extraction Kit 250. The linearized DNA was quantified and stored at 4° C.

Ligation of sgRNAs with the pX459-v2.0 Vector

The protocol described by NEB (Quick ligation protocol—M2200) was followed.

Ligation Reaction 1×:

| Ligation reaction | Reaction 1× | Volume (20 μl) |
|---|---|---|
| Ligase buffer solution 2× | 1× | 10 μl |
| sgRNA (20 ng/μl) | 3× (75 ng) | |
| Plasmid | 1× (25 ng) | |
| Ligase | 1× | 1 μl |
| $H_2O$ | | Up to 20 μl |
| TOTAL | | 20 μl |

The ligation products (sgRNA+vector px459-v2.0) that gave rise to the new plasmids were identified:

| Name of gRNAs cloned in px459-v2.0 |
|---|
| px459v2.0-sgRNA1-SB1/UL45-46 |
| px459v2.0-sgRNA2-SB1/UL45-46 |
| px459v2.0-sgRNA3-SB1/UL45-46 |
| px459v2.0-sgRNA4-SB1/UL45-46 |

The px459v2.0-sgRNA1-SB1/UL45-46 was selected for the following cloning steps.

Transformation into Competent *E. coli* DH5a Bacteria with the Ligation Product to Obtain the Recombinant Plasmid Px459v2.0-sgRNA1-SB1/UL45-46.

The ligation product (sgRNA+vector px459-v2.0) was added to competent *E. coli* DH5a cells, followed by heat shock from 4° to 42° C.

The transformed bacteria were grown in Luria Bertani broth (LB) supplemented with the antibiotic ampicillin (100 μg/ml), and were transferred by seeding to LB agar plates supplemented with ampicillin (100 μg/ml) for subsequent selection of clones (recombinant plasmids).

Extraction and Purification of the Recombinant Plasmid px459v2.0-sgRNA1-SB1/UL45-46

Clones (recombinant plasmids) were selected, grown in LB broths supplemented with ampicillin (100 μg/ml), the bacterial pellet was concentrated, and the plasmid was extracted using the QIAprep® Spin Miniprep Kit (250) extraction kit, according to the manufacturer's instructions, using the QIAcube equipment and the correct insertion of the sgRNA into the plasmid pX459-v2.0 was verified through the digestion product with the BbsI-HF digestion enzyme in the 1% agarose gel electrophoresis run. Finally, the UL45-46 specific sgRNA of SB1 was named px459v2.0-sgRNA1-SB1/UL45-46.

Design and Construction of the Donor Plasmid

For the construction of the donor plasmid, two consecutive cloning processes were performed: the open reading frame (ORF) of the fusion protein (F) of genotype XII strain PP2011 (NDV/peacock/Peru/2011) (GenBank accession number: KR732314) (SEQ ID NO. 3), which is flanked at both ends by the SfiI restriction site (upstream and downstream). This sequence was subsequently synthesized and cloned into plasmid pUC57 by GenScript, the resulting plasmid was named pUC57-F.

The plasmid pGEM-sgA-GFP, previously constructed. This plasmid was digested and linearized by the enzyme SfiI. The plasmid pGEM-sgA-GFP (this plasmid contains: sgA+murine cytomegalovirus promoter+Sfi cleavage sites+a SV40 Poly A signal sequence+a GFP expression cassette for the expression of the fluorescence reporter gene, the latter flanked by LoxP+sgA sequences).

The plasmid pUC57-F was digested by the enzyme SfiI to release the F cassette, then this cassette was cloned into the plasmid pGEM-sgA-GFP (linearized), the resulting plasmid was named pGEM-sgA-GFP-mCMV-F-Poly A (8886 bp).

The correct insertion and orientation of the F expression cassette was verified by PCR using specific primers and by sequencing (data not shown).

transfected for 24 hours using Lipofectamine® Reagent (Thermo Fisher Scientific) following the manufacturer's instructions.

At 24 hours post-transfection, the supernatant containing the DNA complex: Lipofectamine was removed and replaced with fresh maintenance medium, to avoid any toxicity to the cell monolayer.

At three days post transfection, infected/transfected cells were transferred and distributed into 2 6-well CEF cell culture plates previously seeded.

At four days post-transfection/infection, lysis plaques emitting GFP fluorescence were visible, corresponding to the recombinant virus. Selected clones were then purified with three rounds of plaque purification. Single cells expressing the F/GFP protein were selected and distributed into 96-well cell culture plates by fluorescence-activated cell sorting (FACS) on a BD FACSMelody™ Cell Sorter (BD Biosciences). Finally, the new recombinant virus was named rSB1-GFP-F (SEQ ID NO. 4). The presence and expression of the F cassette was then verified by conventional PCR, IIF, and Western blot.

Selection of rSB1-GFP-F Recombinant Clones

Recombinant clones of rSB1-GFP-F were evaluated by conventional PCR to confirm the correct insertion of the F/GFP cassette into the SB1 genome post-transfection and purification. Twelve clones (C1 to C12) were selected and infected into previously seeded CEF cells, then trypsinized upon reaching an infection percentage of 70%. Viral DNA was extracted and analyzed by conventional PCR using the following specific primers: MDV2-UL45-UL46 F2/MDV2-UL45-UL46 R2 (Data not shown).

TABLE 2

List of primers and sgRNAs used in this invention study

| SB1 (MDV-2) primers and sgRNAs | Address | Sequences (5'-> 3') | SEQ No. |
|---|---|---|---|
| 1F | Forward primer | CGTTGTAAAACGACGGCCAG | SEQ ID NO. 6 |
| 1R | Reverse primer | TGGCTTGGGAACAATACCCT | SEQ ID NO. 7 |
| 2F | Forward primer | ATTGAGTCACCACCCCTATGC | SEQ ID NO. 8 |
| 2R | Reverse primer | CCCAACTTCTCGGGGACTGT | SEQ ID NO. 9 |
| MDV2-UL45-UL46 F2 | Forward primer | GCAACGCTACCGAGCTAGAA | SEQ ID NO. 10 |
| MDV2-UL45-UL46 R2 | Reverse primer | AACCCTCCCTGCCACTTTTT | SEQ ID NO. 11 |
| SB1_FXII_UL46F | Forward primer | AGTCATCGTGACAGGCAACC | SEQ ID NO. 12 |
| SB1_FXII_UL46R | Reverse primer | CTACGACGGGATTGGCGATT | SEQ ID NO. 13 |
| gRNA1_UL45/46/SB1_T | Upper chain | CACCGGCGCGTTCAAAAAAAACAC | SEQ ID NO. 14 |
| gRNA1_UL45/46/SB1_B | Lower chain | AAACGTGTTTTTTTTGAACGCGCC | SEQ ID NO. 15 |

Generation of the Recombinant rSB1-GFP-F $0.5\times10^6$ CEF cells were seeded per well in a 6-well cell culture plate in maintenance medium (DMEM 1×+5% FBS) at 37° C. under 5% $CO_2$ atmosphere. After 24 hours, the supernatant was removed and the monolayer was washed 3 consecutive times with DPBS 1× to remove cellular debris. Cells were infected with SB1wt at a multiplicity of infection (MOI) of 0.001 for 8 hours at 37° C. and 5% $CO_2$ in medium DMEM 1×+5% FBS.

The next day, 1 μg of plasmid pGEM-sgA-GFP-mCMV-F-Poly A containing the mCMV-F-polyA cassette, 0.5 μg of sgRNA-sgA, and 0.5 μg sgRNA SB1 UL45-46, were co- Removal of the GFP Reporter Cassette by the Cre-Lox System The GFP expression cassette (flanked by LoxP sequences) from rSB1-GFP-F was removed by the Cre-Lox system. A monolayer of CEF cells was prepared in a 6-well cell culture plate and then infected with rSB1-GFP-F virus with MOI of 0.01 for 24 hours. The infected monolayer was then co-transfected with 2 μg of Cre-recombinase using Lipofectamine® Reagent (Thermo Fisher Scientific) following the manufacturer's instructions.

After 12 hours post-transfection the culture medium was changed to avoid any cytotoxic effect. Verification of the complete removal of the GFP reporter gene expression cassette was confirmed by the appearance of new non-fluorescent lysis plaques. Finally, the new recombinant virus obtained was named rSB1-F (SEQ ID NO.5).

Selection of Recombinant rSB1-F Clones after Removal of the GFP Reporter Cassette Verification of the complete removal of the GFP reporter cassette in the rSB1-GFP-F clones was carried out by conventional PCR using specific primers: MDV2-UL45-UL46 F2/MDV2-UL45-UL46 R2. Likewise, these same primers allowed the integrity of the F cassette in SB1 to be assessed.

Indirect Immunofluorescence Assay (IIF) Detection of F Protein Expression

CEF cells were grown in 12-well cell culture plates and then infected with MOI of 0.001 with SB1wt and rSB1-F. After 48 hours post-infection (hpi), cells were washed three times with DPBS 1× and then fixed with 4% paraformaldehyde for 30 min at room temperature. Cells were incubated with the primary antibody in a solution of 5% bovine serum albumin (BSA) in DPBS for 1 h at room temperature. A chicken anti-MDV antibody (Charles River Avian Vaccine Services, Norwich, USA) was used as a positive control for the detection of SB1 infection, and the rabbit primary antibody against NDV F (GenScript, Piscataway, NJ, USA) was used for the detection of F protein expression. After three washes with DPBS 1×, cells were incubated with Alexa Fluor®405 goat anti-chicken IgY antibody (Abcam, Cambridge, MA, USA) (blue fluorescence) and Alexa Fluor®594 goat anti-rabbit IgG H&L antibody (Abcam, Cambridge, MA, USA) (red fluorescence), respectively, in DPBS 1× with 5% BSA for 45 min at room temperature. The results were observed using an ObserverA1 fluorescence microscope (Carl Zeiss, Germany). Digital images were taken at 50× magnification and processed with the AxioCam MRc5 camera (Carl Zeiss, Germany).

Western Blot

To evaluate the expression of NDV F protein, CEF cells were infected with the recombinant virus with MOI of 0.01. At 72 hpi, CEF cells were lysed and analyzed by Western blot. Western blot analysis was performed using a specific primary antibody against NDV F (GenScript) diluted 10/5000 in 1% milk in 0.1% PBS-T for 15 hours at room temperature with constant agitation. Subsequently, three washes were performed with 0.1% T-TBS (each wash for 10 min with constant agitation). After finishing the washes, the membrane was incubated with the monoclonal anti-Rabbit IgG HRP secondary antibody (Catalog No. A01827, GenScript, Piscataway, NJ, USA) diluted 1/5000 in 1% milk in 0.1% PBS-T for 2 hours at room temperature with constant agitation.

Visualizations of protein expression were detected using a photodocumenter and an AZURE CCD camera (Azure Biosystems, Inc., Dublin, USA).

In Vitro Genetic Stability of rSB1-F

Genetic stability was assessed in CEFs up to passage 20. Viral DNA was extracted from infected CEF cells, and the presence of the F cassette and insert was verified every 5 passages, which was confirmed by conventional PCR using specific primers MDV2-UL45-UL46 F2/MDV2-UL45-UL46 R2. F protein expression was assessed every 5 passages by Western blot assay, as previously described in the Western blot section.

Experimental Design No. 1:

Immunization of SPF Birds with the rSB1-F Vaccine

Twenty 1-day-old SPF chicks were randomly divided into two groups: Group No. 1=rSB1-F (n=10) that was immunized with 3000 plaque-forming units (PFU) of rSB1-F vaccine per bird subcutaneously and Group No. 2=non-immunized control (n=10). At 34, 46, and 55 days post-immunization, serum samples were collected to evaluate the humoral immune response by detecting specific antibodies against the NDV Fusion protein, using an ELISA Kit from ID Screen Newcastle Disease Indirect (ID. Vet)—NDVS.

To evaluate the protective efficacy of rSB1-F, immunized and non-immunized birds were partially transferred to the biosafety level 3 (BSL-3) facilities of FARVET S.A.C. Birds were challenged at 59 days post-immunization with $10^4$ $TCID_{50}$ of NDV genotype XII strain PP2011 with 0.1 ml (0.05 ml per ocular cavity and 0.05 ml per nasal cavity). Observations were made for a period of 14 days post-challenge (d.p.d) to evaluate clinical signs; which were recorded and reported daily. To determine viral shedding, oral and cloacal swab samples were collected (3, 5, and 7 d.p.d) from immunized and non-immunized birds, respectively. Following collection, swabs were immediately soaked in 1 ml of PBS 1× supplemented with antibiotic-antimycotic (final concentration of 10×) for a 30-minute (min) resting time at 4° C. Each swab was then removed and the supernatant was clarified to remove cellular debris and/or food/fecal residue by centrifugation at 3000 rpm for 15 min at 4° C. Samples were quantified by plaque assay.

Experimental Design No. 2:

Immunization of Broilers with the rSB1-F Vaccine

Twenty 1-day-old broilers were randomly divided into two groups: Group No. 1=rSB1-F (n=10) that was immunized with 3000 PFU of rSB1-F per bird subcutaneously and Group No. 2=non-immunized control (n=10). At 20, 34, and 41 days post-immunization, serum samples were collected to evaluate the humoral immune response by detecting specific antibodies against the NDV F protein, using an ELISA Kit from ID Screen Newcastle Disease Indirect (ID. Vet)—NDVS.

To evaluate the protective efficacy of rSB1-F, immunized and non-immunized birds were partially transferred to the BSL-3 facilities of FARVET S.A.C. Birds were challenged at 44 days post-immunization with $10^4$ $TCID_{50}$ of NDV genotype XII strain PP2011 with 0.1 ml (0.05 ml per ocular cavity and 0.05 ml per nasal cavity). Observations were made for a period of 14 d.p.d. to evaluate clinical signs; which were noted and reported daily.

To determine viral dissemination, oral and cloacal swab samples were collected (3, 5, and 7 d.p.d) from immunized and non-immunized birds, respectively. Following collection, the swabs were immediately soaked in 1 ml of PBS 1× supplemented with antibiotic-antimycotic (final concentration of 10×) for a 30 min resting time at 4° C. Then each swab was removed and the supernatant was clarified to remove cellular debris and/or food/feces debris by centrifugation at 3000 rpm for 15 min at 4° C. Samples were quantified by plate assay.

Statistical Analysis

All statistical analysis was performed using GraphPad Prism version 8.01 (GraphPad Software, San Diego, CA). Two-way Anova test was used to compare data between different groups. Differences were considered with p value $<0.0001$. Elisa titers were analyzed using Turkey's multiple comparison test at 95%.

1. Results:

Construction and Recovery of Recombinant Virus rSB1-F

The sgRNAs (sgRNA-sgA and sgRNA-UL45-46) were designed, synthesized, and cloned into plasmid px459v.20, which contains the *S. pyogenes* Cas9 gene. The resulting plasmids were named px459v2.0-sgRNA-sgA and px459v2.0-sgRNA-UL45-46.

The donor plasmid pGEM-sgA-GFP-F contains the GFP reporter expression cassette which is flanked by two LoxP sequences for its separation from the F expression cassette. The two cassettes were flanked by sg-A sites to introduce a desired cleavage for the release of the cassette and integration into the UL45-46 intergenic region of the SB1wt genome. The Cas9 endonuclease promotes the insertion of the GFP and NDV cassette into the UL45-46 intergenic region of the SB1wt genome, see FIG. 1.

For generation of rSB1-GFP-F virus, CEF cells were co-transfected with plasmids pGEM-sgA-GFP-F, px459v2.0-sgRNA-sgA, and px459v2.0-sgRNA-UL45-46. At 24 h post-transfection, cells were infected with SB1wt virus with MOI of 0.01. Plaques expressing GFP were visible at 3 days post-transfection/infection, demonstrating successful cassette insertion. Recombinant virus was isolated in three rounds of purification by lysis plaque isolation and Cell Sorter.

Figure 4:
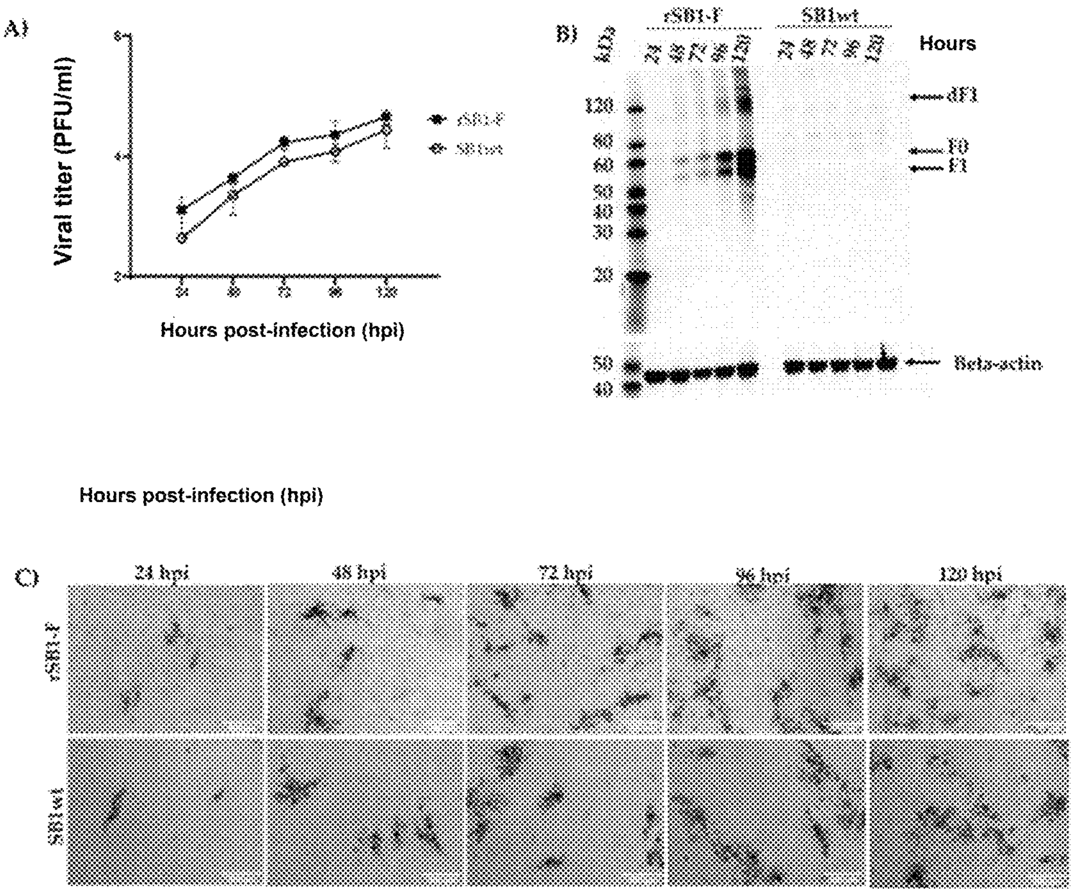
FIG. 4 shows the biological characterization of the rSB1-F virus. (A) Replication kinetics of rSB1-F and SB1wt in CEF cells, infected with MOI 0.001, harvested every 24 hours (24 to 120 hours post-infection), titers were expressed in plaque-forming units (PFU/ml). (B) Kinetics of expression of NDV F protein in CEFs cells infected with rSB1-F. Cells were infected with MOI of 0.001 of rSB1-F and SB1wt, every 24 hours the cell lysates were collected and analyzed by Western blot, detecting a band of ~52 kDa (F1), a band of ~59 kDa (F0) and finally a band of ~120 kDa (dF1) of the F protein, beta-actin (β-actin) was detected as a run control and as a negative control of the experiment, CEF cells infected with SB1wt were used, in which no band was detected. (C) Infection process and lysis plaque formation of rSB1-F and SB1wt in CEF cells. Cells were infected with MOI of 0.001, every 24 hours post-infection, cells were fixed with 4% paraformaldehyde, finally images were captured using an inverted phase contrast microscope.

Subsequently, removal of the GFP reporter cassette was performed with Cre-recombinase (pcDNA3.1-Cre) treatment through the Cre-LoxP system. Cells infected with the rHVT-GFP-F virus were co-transfected with Cre-recombinase; lysis plaques without fluorescence emission were visible 4 days post-transfection/infection. Complete removal was confirmed by conventional PCR using specific primers MDV2-UL45-UL46 F2 and MDV2-UL45-UL46 R2 (FIG. 4C). Finally, the new recombinant virus was named rSB1-F.

Selection of Clones after Removal of GFP Reporter Cassette

After removal of the GFP reporter cassette, five recombinant clones rSB1-F were selected, from which the complete removal of the GFP reporter cassette was verified by conventional PCR using specific primers: MDV2-UL45-UL46 F2/MDV2-UL45-UL46 R2. Clones C1 to C5 presented the expected size of 4112 bp, demonstrating the complete removal of the reporter cassette and integrity of the NDV F cassette, in the UL45-46 intergenic region of the *Gallid alphaherpesvirus* 3 (SB1) genome. Clone C1 was selected for the following evaluations as a characterization of the recombinant virus.

Stability of the F Gene in the Genome of the Recombinant Virus rSB1-F

Figure 3:
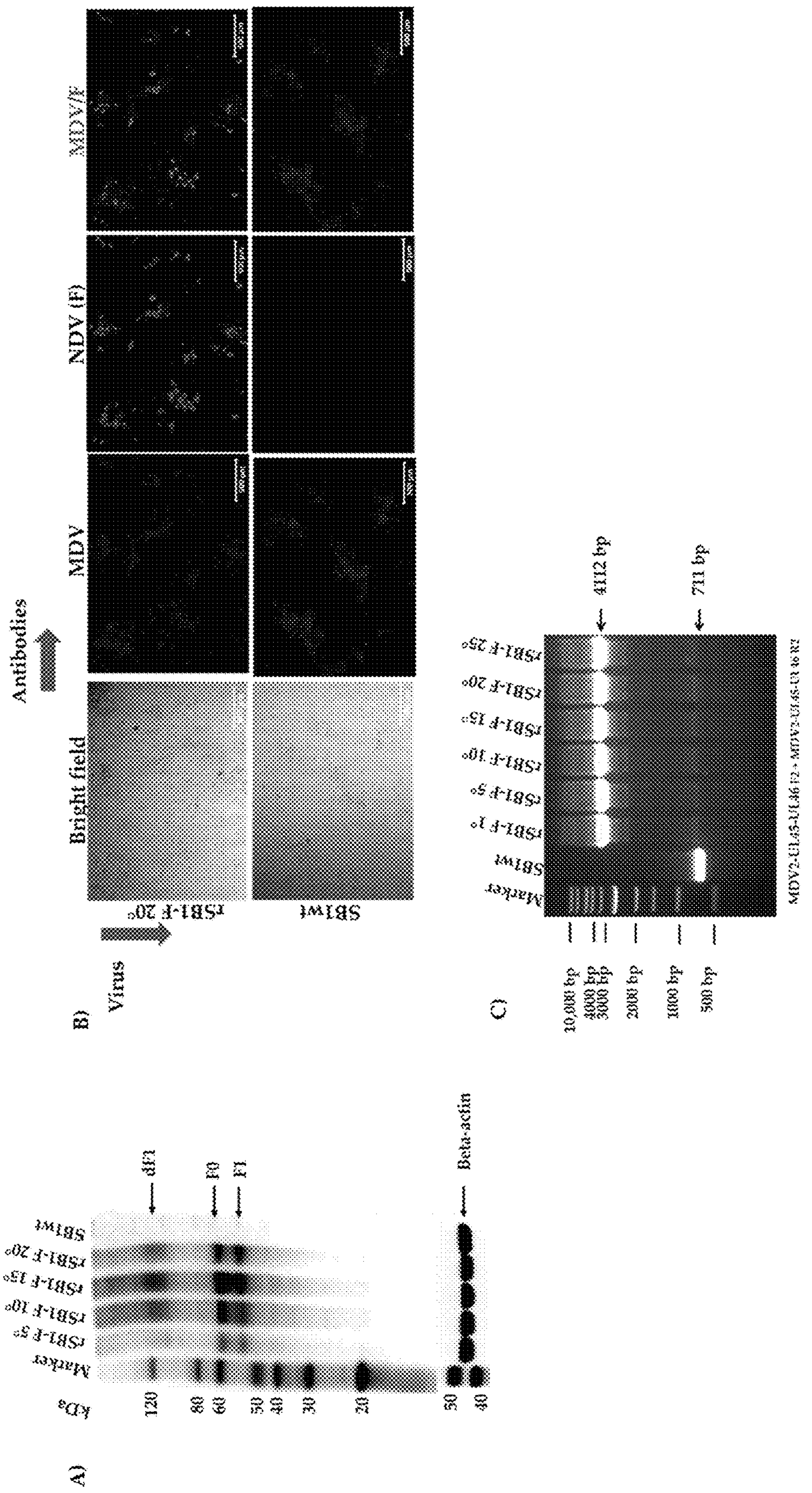
FIG. 3 shows the in vitro assessment of the stability of the F gene in the *Gallid alphaherpesvirus* 3 (SB1 strain) rSB1-F genome. CEF cells were infected with rSB1-F virus for 25 passages. (A) F protein expression was assessed in rSB1-F-infected CEF cells by Western blot every 5 passages (passage 5 to 20), where we detected a band of ~52 kDa corresponding to the subunit (F1), a band of ~59 kDa corresponding to the inactive precursor (F0), and finally a band of ~120 kDa corresponding to the F1 dimer (dF1) of the F protein. As a negative control we used CEF cells infected with SB1wt, in which no band was detected. (B) Indirect immunofluorescence assay (IIF) demonstrated expression of the F protein (red fluorescence) in cells infected with the recombinant virus rSB1-F at passage 20 in CEFs. In addition, expression of MDV-2 proteins (blue fluorescence) was detected, as well as expression of both proteins (blue/red fluorescence). CEF cells infected with SB1wt were used as a negative control. (C) Every 5 passages the presence of the F gene in the rSB1-F genome was evaluated by conventional PCR, SB1wt.

CEFs cells were infected with the rSB1-F virus for 20 passages to determine the genetic stability of the virus by indirect immunofluorescence (IIF), polymerase chain reaction (PCR) and Western blotting. Viral DNA was analyzed every 5 passages by conventional PCR where we detected the presence of the F gene with a band of ~4112 bp (FIG. 3C). Similarly, every 5 passages (passage 5 to 20) we confirmed the expression of the F protein by Western blotting (FIG. 3A) where we detected three bands: a band of ~52 kDa corresponding to the subunit (F1), a band of ~59 kDa corresponding to the inactive precursor (F0), and finally a band of ~120 kDa corresponding to the F1 dimer (dF1) of the F protein. IIF demonstrated the expression of the F protein in cells infected with the recombinant virus at passage 20 in CEFs (FIG. 3B). These results demonstrated that the presence and expression of the NDV F protein gene did not affect the replication of the recombinant virus, confirming the stability of the F gene in the viral genome of the recombinant.

Humoral Response

Figure 5:
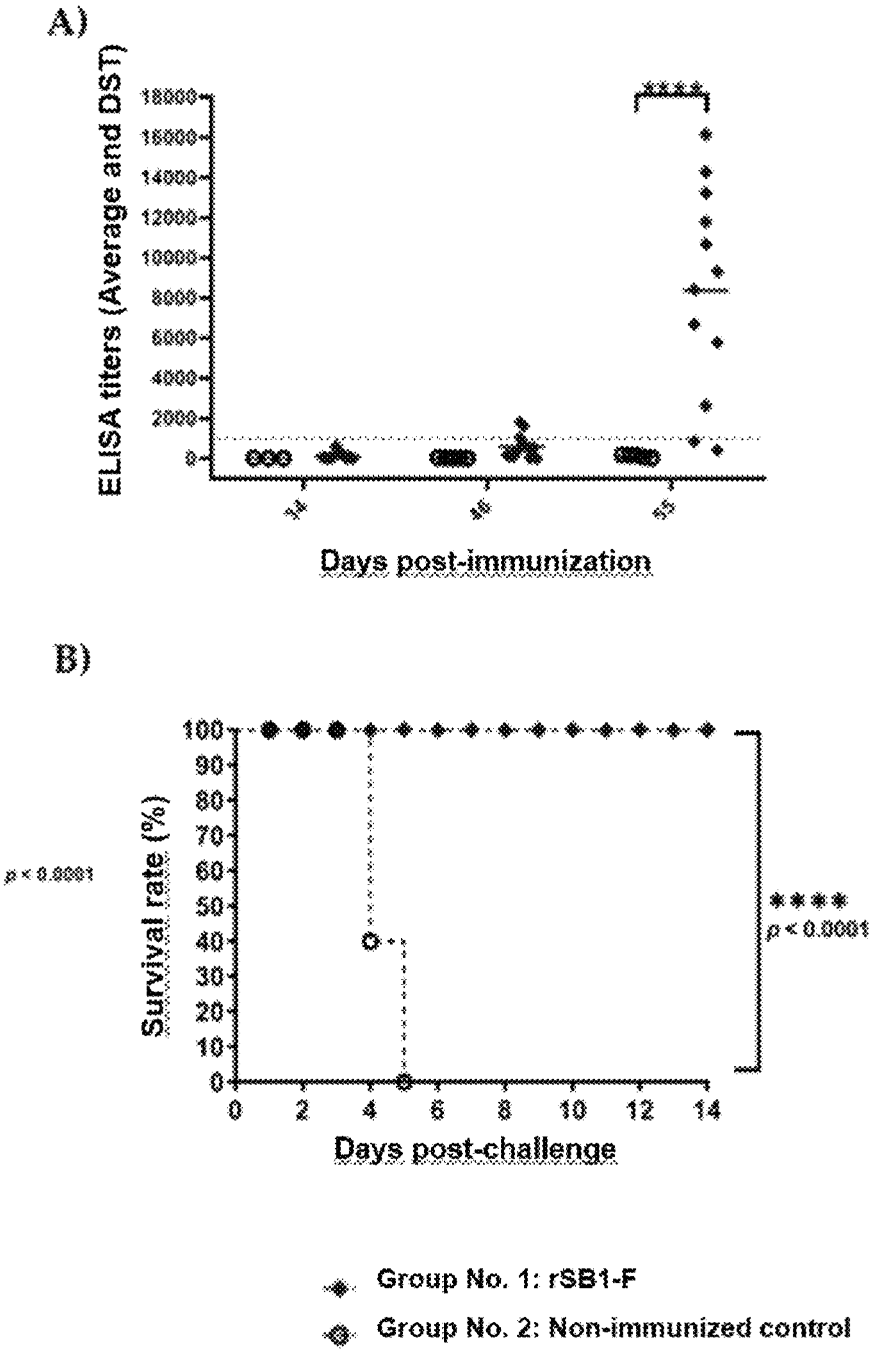
FIG. 5 shows the results of the evaluation of the humoral immune response using an ID Screen Newcastle Disease Indirect (ID. Vet)—NDVS ELISA Kit assay of experiment No. 1 in SPF birds. (A) Antibodies were monitored in serum samples at 34, 46, 55 days post-immunization, using an ELISA kit specific for the NDV F protein. The mean titers and standard deviation are represented by a horizontal bar and whiskers. Positive samples were considered above the cut-off limit (Cut off: 993 titer). (B) Survival percentage of experiment No. 1 (Groups: No. 1 and No. 2), were evaluated up to 14 days post-challenge.

A specific immune response against NDV was detected in group No. 1 rSB1-F (Experiment No. 1) at 46 days post-immunization (585.33±175.22), with 100% of these being positive at 55 days post-immunization (10/10) (8342.9±1506.28). On the other hand, in group No. 2 non-immunized control (Experiment No. 1) no immune response was detected at 46 (21.40±6.32) and 55 days post-immunization (116.200±30.44) being the Cut-off of kit 993, this last monitoring being significant with the non-immunized control group $p<0.0001$ **, see FIG. 5**A.

Figure 6:
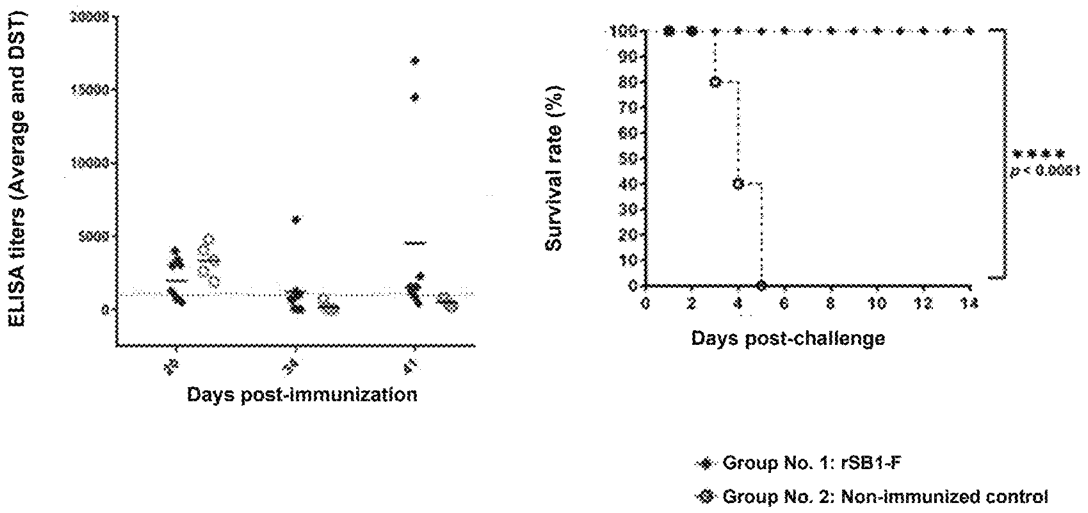
FIG. 6 shows the results of the evaluation of the humoral immune response by an ELISA Kit assay of ID Screen Newcastle Disease Indirect (ID. Vet)—NDVS of experiment No. 2 in broilers. (A) Antibodies were monitored in serum samples at 20, 34, 41 days post-immunization, using an ELISA kit specific for the NDV F protein. The mean titers and standard deviation are represented by a horizontal bar and whiskers. Positive samples were considered above the cut-off limit (Cut off: 993 titer). (B) Survival percentage of experiment No. 2 (Groups: No. 1 and No. 2), were evaluated up to 14 days post-challenge.

To determine if the rSB1-F vaccine was able to overcome the maternal antibodies as the HVT recombinant vector, a second experiment was performed in broilers (experiment No. 2). Chicks immunized at 1 day of age were monitored at 21 days post immunization detecting high titers of antibodies (1959.00±1366.98) being the cut-off of kit 993, which were interpreted as maternal antibody titers because only 9 chicks out of 10 (9/10) were positive. Then at 34 days post immunization 2/10 were positive (1190.22±1909.31) being the cut-off of kit 993. And finally at 41 days post immunization 8/10 were positive (4521.55±6401.52) being the cut-off of kit 993, see FIG. 6A.

Efficacy Against NDV Genotype XII Challenge

Protective efficacy in experiments 1 and 2 was demonstrated by the absence of clinical signs and mortality during the 14 days post-challenge (d.p.d). One-day-old birds were immunized with a single full dose of rSB1-F vaccine (in 0.2 ml diluent/dose) subcutaneously in the back of the neck, then challenged at 59- and 44-days post-immunization respectively with NDV genotype XII by the oculonasal route.

All immunized chicks (Experiment No. 1 and 2) showed complete protection, resulting in 100% viability and protection (10/10). In contrast, non-immunized control chicks (Experiment No. 1 and 2) showed typical clinical signs of the disease between 3 and 4 d.p.d., accumulating a total mortality of 100% (10/10) at 5 d.p.d. (Table 5) see FIGS. 5B and 6B.

Viral shedding of NDV genotype XII challenge virus in birds (Experiment No. 1 and 2) was quantified from tracheal and cloacal swab samples collected by plaque assay (3, 5, and 7 d.p.d). A significant reduction effect on viral shedding titers was shown in respiratory tract samples (tracheal swab samples) from vaccinated birds compared to the non-vaccinated control group after challenge. On the other hand, surprisingly viral shedding in the intestinal tract was completely reduced i.e., viral replication of NDV genotype XII was neutralized in SPF birds and broilers. On the contrary, it was observed that in the non-immunized control groups of both experiments No. 1 and 2, they presented a significant high viral shedding compared to the immunized groups, see Table 3 and 4.

TABLE 3

Frequency of tracheal and cloacal viral dissemination of the NDV genotype XII challenge virus, in SPF birds immunized with rSB1-F experiment No. 1

| | 59 days post-immunization | | | | | |
|---|---|---|---|---|---|---|
| | 3 d.p.d.[(a)] | | 5 d.p.d. | | 7 d.p.d. | |
| Groups | Tracheal | Cloacal | Tracheal | Cloacal | Tracheal | Cloacal |
| Group No. 1 = rSB1-F | 2/7 | 0/7 | 1/7 | 0/7 | 0/7 | 0/7 |
| Group No. 2 = Non-immunized control | 7/7 | 6/7 | 4/4 | 4/4 | NS[(b)] | NS |

TABLE 4

Frequency of tracheal and cloacal viral shedding of the NDV challenge virus in birds immunized (broilers) with rSB1-F experiment No. 2

| | 44 days post-immunization | | | | | |
|---|---|---|---|---|---|---|
| | 3 d.p.d.[(a)] | | 5 d.p.d. | | 7 d.p.d. | |
| Groups | Tracheal | Cloacal | Tracheal | Cloacal | Tracheal | Cloacal |
| Group No. 1 = rSB1-F | 1/7 | 0/7 | 0/7 | 0/7 | 0/7 | 0/7 |
| Group No. 2 = Non-immunized control | 7/7 | 7/7 | 4/4 | 4/4 | NS[(b)] | NS |

[(a)]d.p.d = days post-challenge
[(b)]NS = non-survivors

TABLE 5

Percentage of viability and mortality post-challenge of birds challenged with NDV genotype XII at 59- and 44-days post-immunization with rSB1-F(XII) in experiment No. 1 SPF chicks and No. 2 (broilers).

| Experiments | Groups | | | Days post-challenge (d.p.d.) 1 | 2 | 3 | 4 | 5 | 6 | 7 |
|---|---|---|---|---|---|---|---|---|---|---|
| Experiment No. 1: Challenge at 59 days post-immunization | Group No. 1 = rSB1-F (n = 10) | Experiment No. 1: Challenge at 59 days post-immunization | Dead birds | 0 | 0 | 0 | 0 | 0 | 0 | 0 |
| | | | % viability | 100% | 100% | 100% | 100% | 100% | 100% | 100% |
| | | | % mortality | 0% | 0% | 0% | 0% | 0% | 0% | 0% |
| | Group No. 2 = Non-immunized control (n = 0) | | Dead birds | 0 | 0 | 5 | 5 | NS | NS | NS |
| | | | % viability | 100% | 100% | 50% | 0% | 0% | 0% | 0% |
| | | | % mortality | 0% | 0% | 50% | 100% | NS | NS | NS |
| Experiment No. 2: Challenge at 44 days post-immunized | Group No. 1 = rSB1-F (n = 10) | Experiment No. 2: Challenge at 44 days post-immunization | Dead birds | 0 | 0 | 0 | 0 | 0 | 0 | 0 |
| | | | % viability | 100% | 100% | 100% | 100% | 100% | 100% | 100% |
| | | | % mortality | 0% | 0% | 0% | 0% | 0% | 0% | 0% |
| | Group No. 2 = Non-control (n = 10) | Experiment No. 2: Challenge at 44 days post-immunization | Dead birds | 0 | 0 | 3 | 5 | 2 | NS | NS |
| | | | % viability | 100% | 100% | 70% | 20% | 0% | NS | NS |
| | | | % mortality | 0% | 0% | 30% | 80% | 100% | NS | NS |

NS: No survivor.

Sequence Listing:

SEQ ID NO.1 Nucleotide sequence of the *Gallid alphaherpesvirus* 3 (GaHV-3) strain SB-1 genome, with GenBank accession number: HQ840738.1
Length: 165,994 base pairs (bp).

SEQ ID NO.2 Nucleotide sequence of the non-coding intergenic region between UL45/46 of the *Gallid alphaherpesvirus* 3 (GaHV-3) strain SB-1 genome, with GenBank accession number: HQ840738.1
Length: 119 bp.

SEQ ID NO.3 Nucleotide sequence of the F gene of NDV strain genotypes NDV/peacock/Peru/2011 XII, with GenBank accession number: KR732614; CDS: 4550-6211 bp.
Length: 1662 bp.

SEQ ID NO.4 Nucleotide sequence of the complete genome of the rSB1-GFP-F virus Length: 171,856 bp.

SEQ ID NO.5 Nucleotide sequence of the complete genome of the rSB1-F virus
Length: 169,390 bp.

SEQ ID NO.6 Nucleotide sequence of the primer or forward primer 1F in the 5' to 3' direction
Length: 20 bp.

SEQ ID NO.7 Nucleotide sequence of the primer or reverse primer 1R in the 5' to 3' direction
Length: 20 bp.

SEQ ID NO.8 Nucleotide sequence of the primer or forward primer 2F in the 5' to 3' direction
Length: 20 bp.

SEQ ID NO.9 Nucleotide sequence of the primer or reverse primer 2R in the 5' to 3' direction
Length: 20 bp.

SEQ ID NO.10 Nucleotide sequence of the primer or forward primer MDV2-UL45-UL46 F2 in the 5' to 3' direction
Length: 20 bp.

SEQ ID NO.11 Nucleotide sequence of the primer or reverse primer MDV2-UL45-UL46 R2 in the 5' to 3' direction
Length: 20 bp.

SEQ ID NO.12 Nucleotide sequence of the primer or forward primer SB1_FXII_UL46F in the 5' to 3' direction
Length: 20 bp.

SEQ ID NO.13 Nucleotide sequence of the primer or reverse primer SB1_FXII_UL46R in the 5' to 3' direction
Length: 20 bp.

SEQ ID NO.14 Nucleotide sequence of the upper chain oligo gRNA1_UL45/46/SB1_T
Length: 24 bp.

SEQ ID NO.15 Nucleotide sequence of the lower chain oligo gRNA1_UL45/46/SB1_B
Length: 24 bp.

Example 2

Construction, immunogenicity and protective efficacy of *Gallid alphaherpesvirus* 3 (GaHV3) that efficiently expresses glycoproteins D-I (gD-I) of avian infectious laryngotracheitis virus (ILTV) in broilers II. Methodology Animals One-day-old broilers (Experiment No. 1) were used to evaluate the immunogenicity and efficacy of the rSB1-ILTV (gD-I) vaccine against avian infectious laryngotracheitis virus (ILTV).

Cells and Viruses

For the generation and maintenance of the recombinant virus rSB1-ILTV (gD-I), CEF cells harvested from 9-10-day old SPF embryonated eggs (Charles River Avian Vaccine Services, Norwich, USA) were used. CEFs were maintained in DMEM/F12 (Thermo Fisher Scientific) supplemented with 5% inactivated FBS (Thermo Fisher Scientific) and antibiotic-antimycotic 1× (Thermo Fisher Scientific), at 37° C., under 5% $CO_2$ atmosphere.

The GaHV3 or MDV-2 virus strain SB1 (GenBank accession no.: HQ840738.1) (SEQ ID NO.1) was used for the generation of the recombinant virus rSB1-ILTV (gD-I), in CEFs cells by CRISPR/Cas9 technology and by the NHEJ repair pathway.

The ILT challenge strain used to evaluate the efficacy of the rSB1-ILTV vaccine (gD-I), was the VFAR-043 strain isolated and reported in South American countries (10.1637/11939-073018-Reg.1).

Design and Construction

The recombinant virus rSB1-ILTV (gD-I) was obtained by CRISPR/Cas9-NHEJ technology using the plasmids and sgRNAs: pGEM-sgA-GFP-mCMV-ILTV (gD-I)-Poly A, px459v2.0-sgRNA-sgA, and px459v2.0-sgRNA1-SB1/UL45-46, px459v2.0-sgRNA2-SB1/UL45-46, px459v2.0-sgRNA3-SB1/UL45-46, and px459v2.0-sgRNA4-SB1/UL45-46.

Design and Construction of sgRNAs and Donor Plasmid

Selection and Design of sgRNAs

The target sequence in this invention was the intergenic region of the UL45 and UL46 genes of the *Gallid alphaherpesvirus* 3 (SB1 strain) genome, which was submitted for gRNA design (http://crispr.mit.edu/), thus selecting 4 sequences with the highest score. The sequences are shown in Table 1.

Plasmid px459v2.0 (catalog no. 62988; Addgene, USA) was digested with BbsI-HF (Neb New England BioLabs, Inc) and then purified using the QIAquick Gel Extraction Kit (Qiagen) following the manufacturer's instructions.

sgRNAs were presented as oligo-DNA primers corresponding to the sgRNA of the target sequence, which were synthesized and cloned into the previously digested px459v2.0 cloning vector for the construction of px459v2.0-sgRNA. The sequence of sg-A was taken from a previous publication and cloned into the px459v2.0 plasmid in the same way. The correct insertion of the sgRNAs was confirmed by digestion with the enzyme BbsI-HF (data not shown).

Sequence of the non-coding intergenic region between UL45/46 of the *Gallid alphaherpesvirus* 3 (strain SB1) genome (SEQ ID NO.2)

```
Size: 119 bp
>acgcgagagaccgagcattagagtagcacttatttattctatcgcagag

aaacaccgcgcgcgttcaaaaaaaacacaggcggggtacgataaatttac

gcggccgcgctatgtttact
```

TABLE 6

Sequences of sgRNAs designed based on the 119 bp sequence of the UL45/46 intergenic region of the *Gallid alphaherpesvirus* 3 (strain SB1) genome (GenBank accession no.: HQ840738.1) https://www.ncbi.nlm.nih.gov/nuccore/HQ840738.1.

| # | sgRNA | 5'----------------------------3' | |
|---|---|---|---|
| 1 | gRNA1_UL45/46/SB1_T | CACCGGCGCGTTCAAAAAAAACAC | gT(+) |
| | gRNA1_UL45/46/SB1_B | AAACGTGTTTTTTTTGAACGCGCC | gB(-) |
| 2 | gRNA2_UL45/46/SB1_T | CACCGGTTCAAAAAAAACACAGGC | gT(+) |
| | gRNA2_UL45/46/SB1_B | AAACGCCTGTGTTTTTTTTGAACC | gB(-) |
| 3 | gRNA3_UL45/46/SB1_T | CACCGGGGGTACGATAAATTTACG | gT(+) |
| | gRNA3_UL45/46/SB1_B | AACCGTAAATTTATCGTACCCCC | gB(-) |
| 4 | gRNA4_UL45/46/SB1_T | CACCGTGTTTTTTTTGAACGCGCG | gT(+) |
| | gRNA4_UL45/46/SB1_B | AAACCGCGCGTTCAAAAAAAACAC | gB(-) |

B = Lower DNA chain, T = Upper DNA chain sgRNAs cloning procedure

Hybridization of sgRNAs

The sgRNA was synthesized as oligo:

5'CACCNNNNNNNNNNNNNNNNNNNNNNNNNNNNNNNNNNNNNNNNCAAA 5'

*The sgRNA was resuspended in nuclease-free water and diluted 1/10 to have a final working concentration of 10 μM.

1× hybridization reaction:

| Hybridization reaction | Volume |
|---|---|
| Hybridization buffer solution 1× | 2 μl |
| sgRNA upper DNA chain (10 μM) | 2 μl |
| sgRNA lower DNA chain (10 μM) | 2 μl |
| $H_2O$ | 14 μl |
| TOTAL | 20 μl |

*Hybridization buffer solution: 10 mM Tris, pH 7.5-8; 50 mM NaCl, 1 mM EDTA.

The samples were placed in the thermocycler under the following conditions:

90° C. for 3 min and 37° C. for 1 hour

The samples were quantified by spectrophotometry using Eppendorf BioPhotometer plus, obtaining an average value of 200 ng/μl. A 1/10 dilution was performed to have a working stock of 20 ng/μl.

Digestion or Linearization of the Plasmid Vector PX459-v2.0 (Catalog No. 62988; Addgene, USA)

Digestion reaction 1×:

| Digestion reaction | Reaction 1× | Volume |
|---|---|---|
| CutSmart Buffer Solution 10× | 1× | 2 μl |
| BbS I-HF enzyme (20 000 U) | 20 units | 1 μl |
| Plasmid (500 ng/ml) | 2 μg | 4 μl |
| $H_2O$ | | 12 μl |
| TOTAL | | 20 μl |

Samples were placed in the thermocycler at 37° C. for 6 hours.

An electrophoresis assay was performed in order to purify the band of interest, which contains the linear DNA. The gel was cut and the DNA was extracted using the QIAquick® Gel Extraction Kit 250. The linearized DNA was quantified and stored at 4° C.

Ligation of sgRNAs with the PX459-v2.0 Vector

The protocol described by NEB (Quick ligation protocol—M2200) was followed.

Ligation reaction 1×:

| Ligation reaction | Reaction 1× | Volume (20 μl) |
|---|---|---|
| Ligase buffer solution 2× | 1× | 10 μl |
| sgRNA (20 ng/μl) | 3× (75 ng) | |
| Plasmid | 1× (25 ng) | |
| Ligase | 1× | 1 μl |
| $H_2O$ | | Hasta 20 μl |
| TOTAL | | 20 μl |

The ligation products (sgRNA+px459-v2.0 vector) that gave rise to the new plasmids were identified:

| Name of gRNAs cloned in px459-v2.0 |
|---|
| px459v2.0-sgRNA1-SB1/UL45-46 |
| px459v2.0-sgRNA2-SB1/UL45-46 |
| px459v2.0-sgRNA3-SB1/UL45-46 |
| px459v2.0-sgRNA4-SB1/UL45-46 |

The px459v2.0-sgRNA1-SB1/UL45-46 was selected for the following cloning steps.

Transformation into Competent *E. coli* DH5a Bacteria with the Ligation Product to Obtain the Recombinant Plasmid Px459v2.0-sgRNA1-SB1/UL45-46.

The ligation product (sgRNA+vector px459-v2.0) was added to competent *E. coli* DH5a cells, followed by heat shock from 4° to 42° C.

The transformed bacteria were grown in Luria Bertani broth (LB) supplemented with the antibiotic ampicillin (100 μg/ml), and were transferred by seeding to LB agar plates supplemented with ampicillin (100 μg/ml) for subsequent selection of clones (recombinant plasmids).

Extraction and purification of the recombinant plasmid Px459v2.0-sgRNA1-SB1/UL45-46 Recombinant plasmids were selected, grown in LB broths supplemented with ampicillin (100 μg/ml), the bacterial pellet was concentrated, and the plasmid was extracted using the QIAprep® Spin Miniprep Kit (250) extraction kit, according to the manufacturer's instructions, using the QIAcube equipment and the correct insertion of the sgRNA into the plasmid pX459-v2.0 was verified through the digestion product with the BbsI-HF digestion enzyme in the 1% agarose gel electrophoresis run. Finally, the UL45-46 specific sgRNA of SB1 was named px459v2.0-sgRNA1-SB1/UL45-46.

Design and Construction of the Donor Plasmid

For the construction of the donor plasmid, two consecutive cloning processes were performed: the Open Reading Frame (ORF) of the D and I genes of ILTV (GenBank accession number: MG: MG775218.1) *Gallid alphaherpesvirus* 1 strain VFAR-043, complete genome—Nucleotide—NCBI (nih.gov) (SEQ ID NO.20), which is flanked at both ends by the SfiI restriction site (upstream and downstream). This sequence was subsequently synthesized and cloned into plasmid pUC57 by GenScript, the resulting plasmid was named pUC57-ILTV (gD-I).

The plasmid pGEM-sgA-GFP, previously constructed. This plasmid was digested and linearized by the enzyme SfiI. The plasmid pGEM-sgA-GFP (this plasmid contains: sgA+murine cytomegalovirus promoter+Sfi cleavage sites+a SV40 Poly A signal sequence+a GFP expression cassette for the expression of the fluorescence reporter gene, the latter flanked by LoxP+sgA sequences).

The plasmid pUC57-ILTV (gD-I) was digested by the enzyme SfiI to release the gD-1 cassette, then this cassette was cloned into the plasmid pGEM-sgA-GFP (linearized), the resulting plasmid was named pGEM-sgA-GFP-mCMV-ILTV (gD-I)-Poly A (9144 bp). The correct insertion and orientation of the ILTV (gD-I) expression cassette was verified by PCR using specific primers and by sequencing (data not shown).

At 24 hours post-transfection, the supernatant containing the DNA complex: Lipofectamine was removed and replaced with fresh maintenance medium, to avoid any toxicity to the cell monolayer.

At three days post transfection, infected/transfected cells were transferred and distributed into 2 6-well CEF cell culture plates previously seeded.

Four days post-transfection/infection, lysis plaques emitting GFP fluorescence were visible, corresponding to the recombinant virus. Selected clones were then purified by three rounds of plaque purification. Single cells expressing the ILTV (gD-I)-GFP expression cassette were selected and plated into 96-well cell culture plates by FACS on a BD FACSMelody™ Cell Sorter (BD Biosciences). Finally, the new recombinant virus was named rSB1-GFP-ILTV (gD-I) (SEQ ID NO. 21). The presence and expression of the ILTV (gD-I) cassette was then verified by conventional PCR, IIF, and Western blot.

Selection of Recombinant Clones rSB1-GFP-ILTV (gD-I)

Recombinant clones of rSB1-GFP-ILTV (gD-I) were evaluated by conventional PCR to confirm the correct insertion of the ILTV (gD-I)/GFP cassette into the SB1 genome post-transfection and purification. Seven clones were selected and infected into previously seeded CEF cells, then trypsinized upon reaching an infection percentage of 70%. Viral DNA was extracted and analyzed by conventional PCR using the following specific primers: MDV2-UL45-UL46 F2/MDV2-UL45-UL46 R2 (Data not shown).

TABLE 7

List of primers and sgRNAs used in this invention study

| SB1 (MDV-2) primers and sgRNAs | Address | Sequences (5'-> 3') | SEQ No. |
|---|---|---|---|
| MDV2-UL45-UL46 F2 | Forward primer | GCAACGCTACCGAGCTAGAA | SEQ ID NO. 10 |
| MDV2-UL45-UL46 R2 | Reverse primer | AACCCTCCCTGCCACTTTTT | SEQ ID NO. 11 |
| gRNA1_UL45/46/SB1_T | Upper chain | CACCGGCGCGTTCAAAAAAAACAC | SEQ ID NO. 14 |
| gRNA1_UL45/46/SB1 B | Lower chain | AAACGTGTTTTTTTTGAACGCGCC | SEQ ID NO. 15 |
| SB1_UL45-F | Forward primer | TATGCGGTTGTACGATCGGG | SEQ ID NO. 16 |
| SB1_ILTV_UL45-R | Reverse primer | AGAAACGTTCCGGAAGGGAC | SEQ ID NO. 17 |
| SB1_EGFP_UL46-F | Forward primer | CCACTCCCACTGTCCTTTCC | SEQ ID NO. 18 |
| SB1_ILTV_UL46-R | Reverse primer | GTTGTGCTTCTACGACGGGA | SEQ ID NO. 19 |

Generation of the Recombinant rSB1-GFP-ILTV (gD-I)

$0.5\times10^6$ CEF cells were seeded per well in a 6-well cell culture plate supplemented with maintenance medium (DMEM 1×+5% FBS) at 37° C. under 5% $CO_2$ atmosphere. After 24 hours, the supernatant was removed and the monolayer was washed 3 consecutive times with DPBS 1× to remove cellular debris. Cells were infected with SB1wt with MOI of 0.001 for 8 hours at 37° C. and 5% $CO_2$ in DMEM 1×+5% FBS medium.

The next day, 1 μg of plasmid pGEM-sgA-GFP-mCMV-ILTV (gD-I)-Poly A containing the mCMV-ILTV (gD-I)-Poly A cassette, 0.5 μg of sgRNA-sgA, and 0.5 μg sgRNA SB1 UL45-46, were co-transfected for 24 hours using Lipofectamine® Reagent (Thermo Fisher Scientific) following the manufacturer's instructions.

Removal of the GFP Reporter Cassette by the Cre-Lox System

The GFP expression cassette (flanked by LoxP sequences) from rSB1-GFP-ILTV (gD-I) was removed by the Cre-Lox system. A monolayer of CEF cells was prepared in a 6-well cell culture plate and then infected with rSB1-GFP-ILTV (gD-I) virus with MOI of 0.01 for 24 hours. The infected monolayer was then co-transfected with 2 μg of Cre-recombinase using Lipofectamine® Reagent (Thermo Fisher Scientific) following the manufacturer's instructions.

After 12 hours post-transfection the culture medium was changed to avoid any cytotoxic effect. Verification of the complete removal of the GFP reporter gene expression cassette was confirmed by the appearance of new non-fluorescent lysis plaques. Finally, the new recombinant virus obtained was named rSB1-ILTV (gD-I) (SEQ ID NO.22).

Selection of Recombinant rSB1-ILTV (gD-I) Clones after Removal of the GFP Reporter Cassette Verification of the complete removal of the GFP reporter cassette in the rSB1-GFP-ILTV (gD-1) clones was verified by conventional PCR using specific primers: MDV2-UL45-UL46 F2/MDV2-UL45-UL46 R2. Likewise, these same primers allowed the integrity of the ILTV (gD-I) expression cassette in SB1 to be evaluated.

Indirect Immunofluorescence Assay (IIF)

CEF cells were grown in 6-well cell culture plate and infected with MOI of 0.001 with SB1wt and rSB1-ILTV (gD-I) at passages 10, 15, 20, and 25. After 48 hours post-infection (hpi), cells were washed three times with 1×DPBS and then fixed with 4% paraformaldehyde for 30 min at room temperature. Cells were incubated with the primary antibody in a solution of 5% bovine serum albumin (BSA) in DPBS for 1 h at room temperature. A primary antibody: anti-Infectious laryngotracheitis serum (catalog no. N0118) (Avian Vaccine Services, LLC dba AVS Bio, Norwich, USA) for detection of gD-I glycoprotein expression. After three washes with DPBS 1×, cells were incubated with a secondary antibody goat anti-chicken IgY H&L Alexa Fluor®488 at a dilution of 1:1000 (catalog no. ab150169, Abcam, Cambridge, MA, USA) (green fluorescence), respectively in 1×DPBS with 5% BSA for 1 hour at room temperature. Results were observed using an ObserverA1 fluorescence microscope (Carl Zeiss, Germany). Digital images were taken at 200× magnification and processed with the AxioCam MRc5 camera (Carl Zeiss, Germany).

Western Blot for Detection of ILTV Glycoproteins D-I (gD-I)

To assess the expression of ILTV gD-I glycoproteins, CEF cells were infected with the recombinant virus with MOI of 0.01. At 72 hpi, CEF cells were lysed and analyzed by Western blot. Western blot analysis was performed using a primary antibody: anti-serum Infectious laryngotracheitis (Catalog No. N0118, Avian Vaccine Services, LLC dba AVS Bio, Norwich, USA) diluted 20/5000 in 1% milk in 0.1% PBST for 15 hours at room temperature with constant agitation. Subsequently, three washes were performed with 0.1% T-TBS (each wash for 10 min with constant agitation). After finishing the washes, the membrane was incubated with the secondary antibody Goat Anti-Chicken IgY (H&L) [HRP](Catalog No. A00165, GenScript, Piscataway, NJ, USA) diluted 1/5000 in 1% milk in 0.1% PBS-T for 2 hours at room temperature with constant agitation.

Visualizations of protein expression were detected using a photodocumenter and an AZURE CCD camera (Azure Biosystems, Inc., Dublin, USA).

In Vitro Genetic Stability of rSB1-ILTV (gD-I).

Genetic stability was assessed in CEFs up to passage 20. Viral DNA was extracted from infected CEF cells, and the presence of the ILTV cassette and insert (gD-I) was verified every 5 passages, which was confirmed by conventional PCR using specific primers MDV2-UL45-UL46 F2/MDV2-UL45-UL46 R2. Expression of gD-I glycoproteins was assessed every 5 passages by Western blot assay, as previously described in the Western blot section.

Experimental Design No. 1: Immunization of Broilers with the rSB1-ILTV Vaccine (gD-I)

For the immunization experiment, three recombinant virus clones obtained rSB1-ILTV (gD-I) clones were evaluated: 15.1, 16.3, 15.7, a commercial rHVT-ILTV vaccine was used as a control, isolated rHVT-ILTV, and a non-immunized control group.

Seventy-two 1-day-old broilers were randomly divided into six groups: Group No. 1=rSB1-ILTV (gD-I) clone 15.1 (n=12), Group No. 2=rSB1-ILTV (gD-I) clone 16.3 (n=12), Group No. 3=rSB1-ILTV (gD-I) clone 15.7 (n=12), Group No. 4=HVT-ILTV (commercial) (n=12), Group No. 5=rHVT-ILTV isolated (n=12) and Group No. 6=non-immunized control (n=12). Chicks were immunized with a dose of 3000 PFU/bird, at 20, 34, and 41 days post-immunization, serum samples were collected to evaluate the humoral immune response by detecting specific antibodies against glycoprotein I (gI) of ILTV, using IDScreen ILT I Indirect (ID.Vet Cat. No ILTGIS).

To assess efficacy against ILTV challenge, immunized and non-immunized birds were partially moved to the BSL-3 facility of FARVET S.A.C. Birds were challenged at 42 days post-immunization by ocular (50 μl in each eye) and intra-tracheal (50 μl) routes and clinical signs were monitored for 10 days, which were recorded and reported daily. Scores for clinical signs were designated as 0=no clinical signs; 1=conjunctivitis, difficulty breathing, or mild hoarseness; 2=conjunctivitis, difficulty breathing, or moderate hoarseness; 3=conjunctivitis, difficulty breathing, or severe hoarseness.

To determine viral shedding, oral and cloacal swabs were collected (3, 5, and 7 d.p.d.) from immunized and non-immunized birds, respectively. Following collection, the swabs were immediately soaked in 1 ml of PBS 1× supplemented with antibiotic-antimycotic (final concentration of 10×) for a resting time of 30 min at 4° C. Each swab was then removed, and the supernatant was clarified to remove cellular debris and/or feed/fecal residue by centrifugation at 3000 rpm for 15 min at 4° C. Samples were quantified by quantitative real-time PCR technique.

Statistical Analysis

All statistical analysis was performed using GraphPad Prism version 8.01 (GraphPad Software, San Diego, CA). The two-way Anova test was used to compare data between different groups. Differences were considered with a p value <0.0001. Elisa titers were analyzed using Turkey's multiple comparison test at 95%.

Results:

Construction and Recovery of the Recombinant Virus

Figure 7:
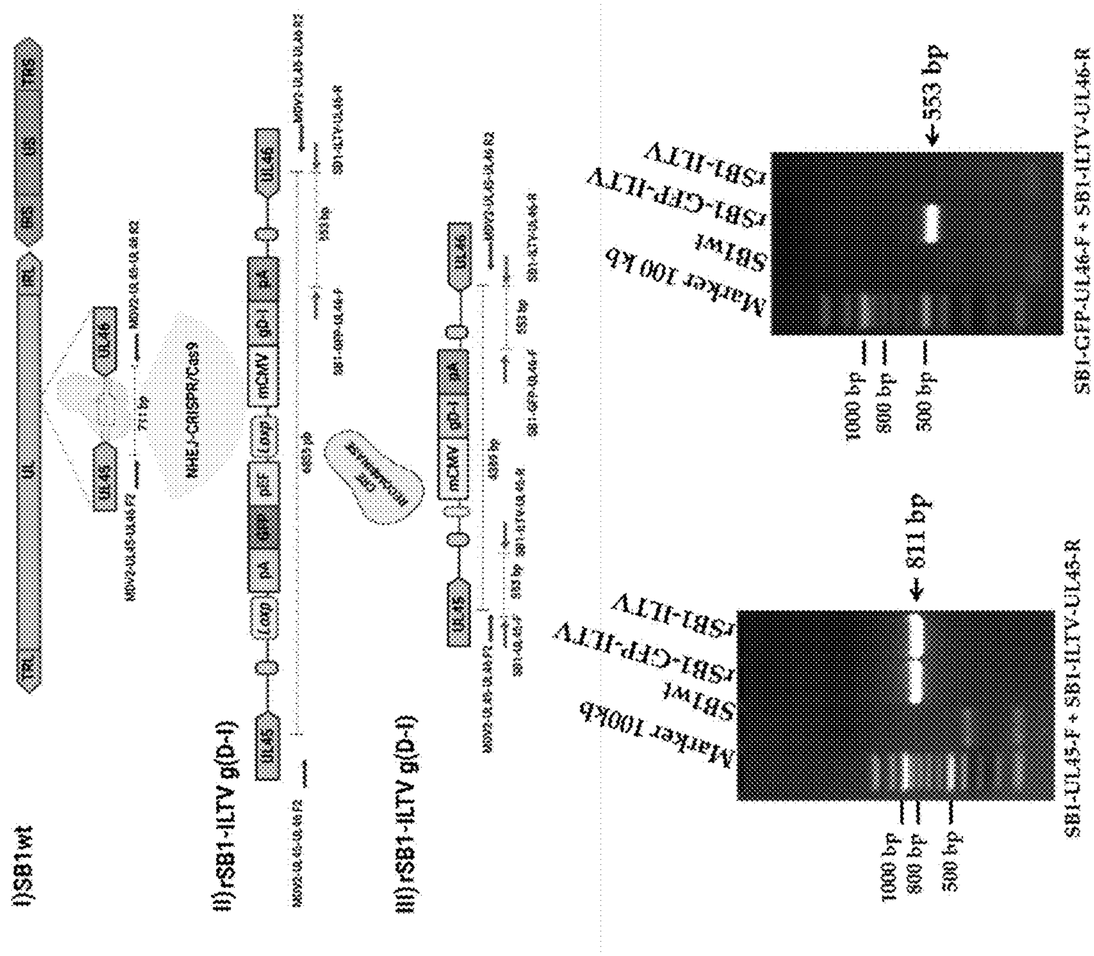
FIG. 7 shows the strategy used for the generation of the rSB1-ILTV (gD-I) virus by CRISPR/Cas9-NHEJ technology. (A) The genome of the parental virus, or SB1wt, is shown with a unique long region (UL), a unique short region (US), and a long (TRL/IRL) and short (TRS/IRS) internal repeat region. Strategy used for the generation of rSB1-ILTV (gD-I) by CRISPR/Cas9-NHEJ. This figure was created with BioRender.com (Figure not scaled). (B) Confirmation of the correct insertion of the ILTV D-I gene expression cassette into the rSB1-GFP-ILTV and rSB1-ILTV genomes was demonstrated using specific primers by conventional PCR.

The sgRNAs (sgRNA-sgA and sgRNA-UL45-46) were designed, synthesized, and cloned into plasmid px459v.20, which contains the *S. pyogenes* Cas9 gene. The resulting plasmids were named px459v2.0-sgRNA-sgA and px459v2.0-sgRNA-UL45-46. The donor plasmid pGEM-sgA-GFP-mCMV-ILTV (gD-I)-Poly A contains the GFP reporter expression cassette which is flanked by two LoxP sequences for its separation from the ILTV (gD-I) expression cassette. The two cassettes were flanked by sg-A sites to introduce a desired cleavage for cassette release and integration into the UL45-46 intergenic region of the SB1wt genome. The Cas9 endonuclease promotes the insertion of the GFP and ILTV cassette into the UL45-46 intergenic region of the SB1wt genome, see FIG. 7.

For generation of rSB1-GFP-ILTV (gD-I) virus, CEF cells were co-transfected with the Poly A plasmids pGEM-sgA-GFP-mMCV-ILTV (gD-I), px459v2.0-sgRNA-sgA, and px459v2.0-sgRNA-UL45-46. At 24 hours post-transfection, cells were infected with SB1wt virus with MOI of 0.01. Plaques expressing GFP were visible at 4 days post-transfection/infection, demonstrating successful cassette insertion. Recombinant virus was isolated in three rounds of purification by plaque isolation and Cell Sorter.

Figure 9:
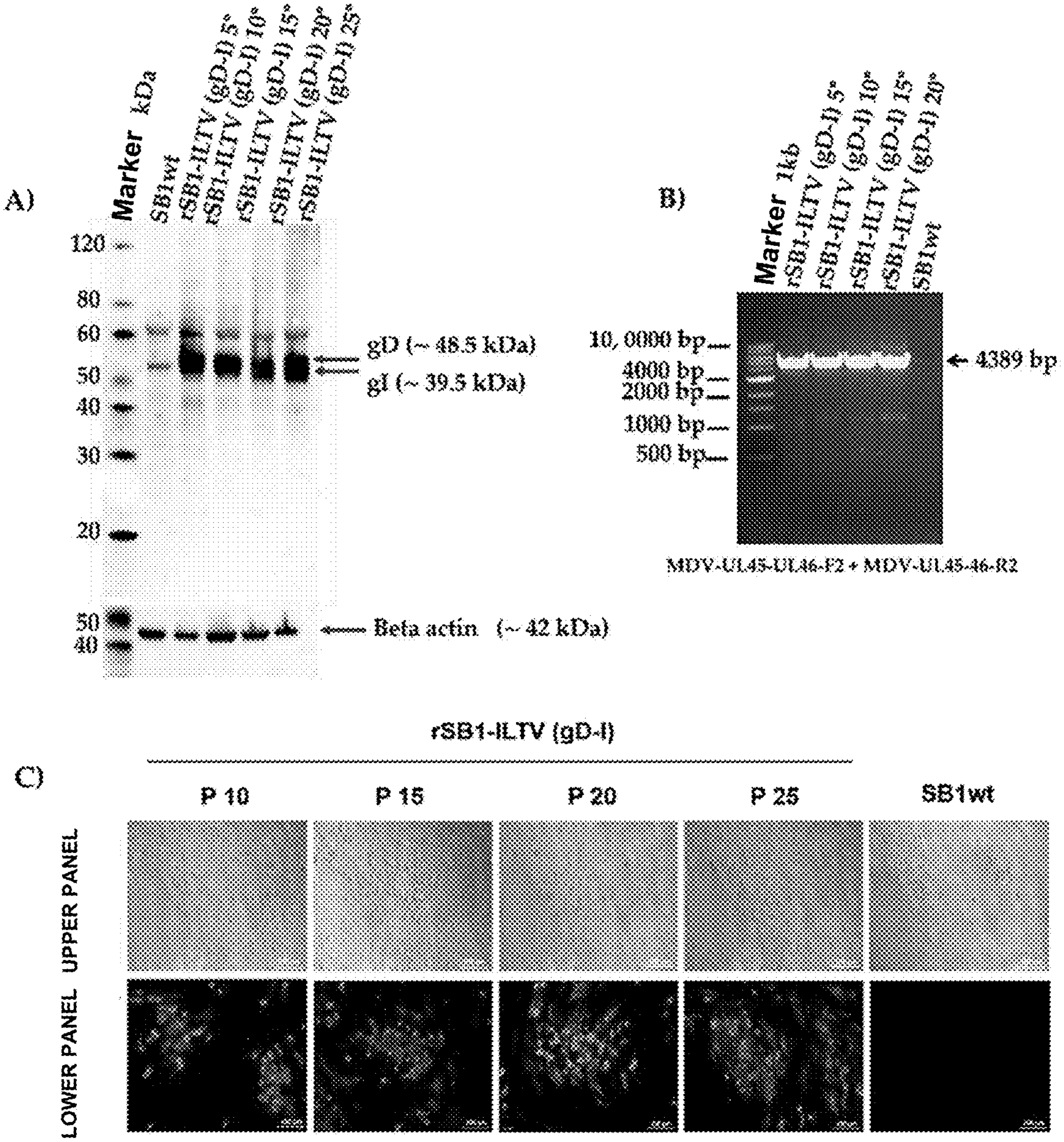
FIG. 9 shows the in vitro evaluation of the stability of the expression cassette containing the genes encoding the ILTV glycoproteins D and I in the *Gallid alphaherpesvirus* 3 genome. CEF cells were infected with the rSB1-ILTV virus (gD-I). (A) The expression of glycoproteins D and I was evaluated in CEF cells infected with rSB1-ILTV (gD-I) by Western blot every 5 passages (passage 5 to 25), where we detected a band of ~48.5 kDa corresponding to glycoprotein D (gD) and a band of ~39.5 kDa corresponding to glycoprotein I (gI). As a run control, beta-actin (β-actin) ~42 kDa was detected and as a negative control of the experiment, CEF cells infected with SB1wt were used, in which no band was detected. (B) Every 5 passages (passage 5 to 20) the presence of the inserted cassette containing the genes encoding the glycoproteins D and I of ILTV in the genome of rSB1-ILTV (gD-I) was evaluated by conventional PCR using specific primers, SB1wt was used as a control. (C) The indirect immunofluorescence assay (IIF) demonstrated the expression of glycoproteins D and I (green fluorescence) in cells infected with the recombinant virus rSB1-ILTV (gD-I), at passages 10, 15, 20, 25 in CEFs. Lower panel (fluorescence emission) and upper panel (bright field). CEF cells infected with SB1wt were used as negative control. Digital images were captured at 200× magnification and processed with the AxioCam MRc5 camera (Carl Zeiss, Germany).

Subsequently, the removal of the GFP reporter cassette was performed with Cre-recombinase (pcDNA3.1-Cre) treatment through Cre-LoxP system, the cells infected with the virus rSB1T-GFP-ILTV (gD-I) were transfected with Cre-recombinase, the appearance of lysis plaques without fluorescence emission was visible at 4 days post-transfection/infection. The complete removal was confirmed by conventional PCR using specific primers MDV2-UL45-UL46 F2 and MDV2-UL45-UL46 R2 (FIG. 9B). Finally, the new recombinant SB1 was named rSB1-ILTV (gD-I).

Selection of Clones after Removal of GFP Reporter Cassette

Figure 8:
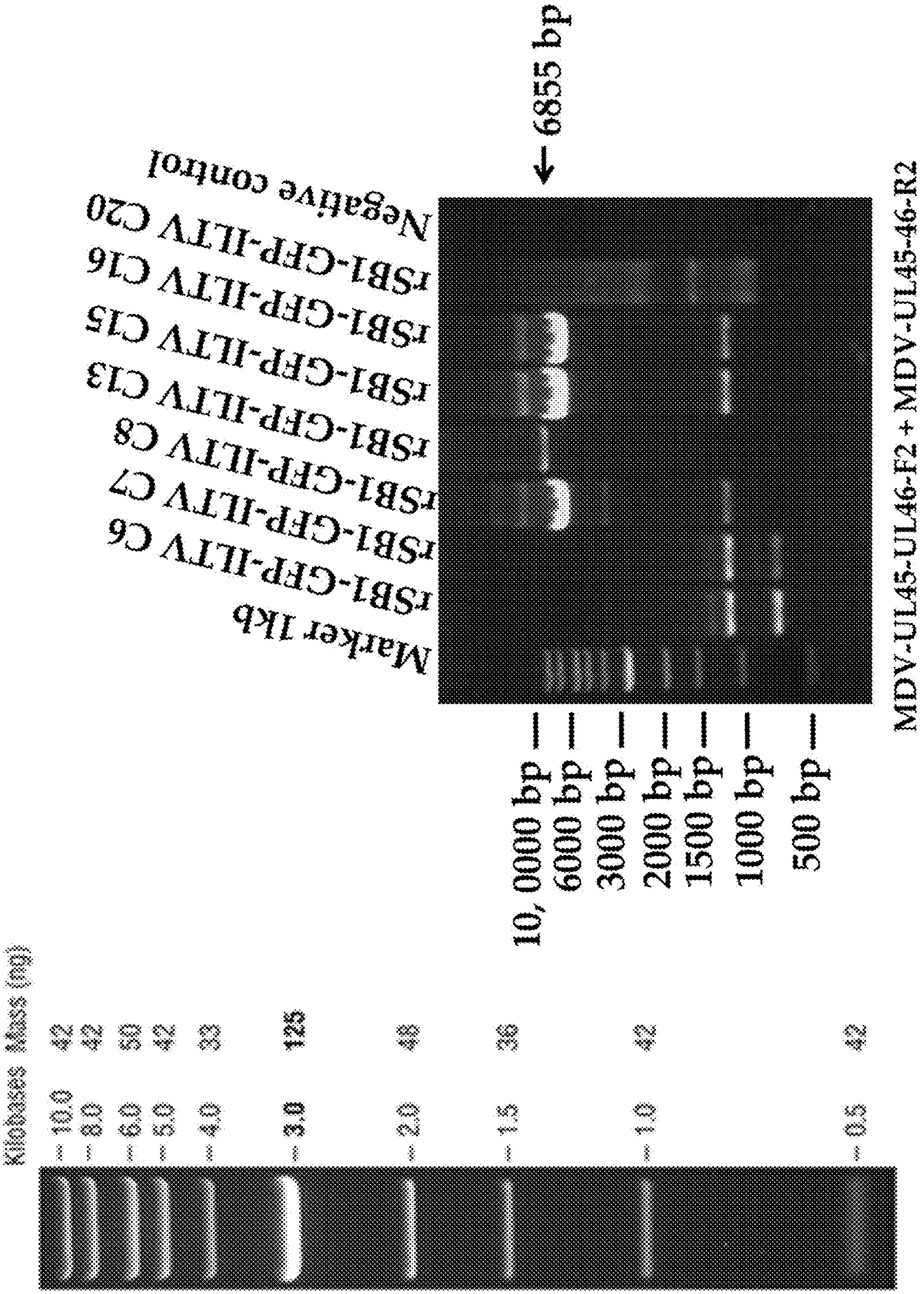
FIG. 8 shows the evaluation and selection of recombinant clones by conventional PCR of rSB1-GFP-ILTV (gD-I) obtained from the transfection stage. The 20 recombinant clones: C6, C7, C8, C13, C15, C16, and C20 were evaluated by PCR with specific primers that amplify the complete expression cassette, the product amplified an expected band of 6855 bp.

Clones C8, C15 and C16 of the rSB1-GFP-ILTV virus (gD-I) presented the expected size of 6855 bp (FIG. 8) before the removal of the GFP reporter cassette, therefore they were selected for the removal of the GFP reporter cassette.

After removal of the GFP reporter cassette, seven recombinant clones rSB1-ILTV (gD-I) were selected, from which the complete removal of the GFP reporter cassette was verified by conventional PCR using specific primers: MDV2-UL45-UL46 F2/MDV2-UL45-UL46 R2. Demonstrating the complete removal of the reporter cassette and the integrity of the ILTV (gD-1) cassette in the UL45-46 intergenic region of the *Gallid alphaherpesvirus* 3 (SB1) genome.

Stability of Genes D and I in the Genome of the Recombinant Virus rSB1-ILTV (gD-I)

CEFs cells were infected with the rSB1-ILTV virus (gD-I) virus to determine the genetic stability of the virus by indirect immunofluorescence (IIF), polymerase chain reaction (PCR) and Western blotting. Viral DNA was analyzed every 5 passages (passages 5 to 20) by conventional PCR where we detected the presence of the cassette inserted in the recombinant virus genome with a band of ~4389 bp (FIG. 9B). Similarly, every 5 passages (passage 5 to 25) we confirmed the expression of glycoproteins D and I by Western blotting (FIG. 9A) where we detected two bands: a band of ~48.5 kDa corresponding to glycoprotein D (gD) and a band of ~39.5 kDa corresponding to glycoprotein I (gI). As a run control, beta-actin (β-actin) ~42 kDa was detected and as a negative control of the experiment, CEF cells infected with SB1wt were used, in which the expression of the proteins of interest was not detected. The IIF demonstrated the expression of both glycoproteins gD-I in cells infected with the recombinant virus at passages 10 to 25 in CEFs (FIG. 9C). These results demonstrated that the presence and expression of the ILTV glycoprotein gD-I gene did not affect the replication of the recombinant virus, confirming the stability of glycoproteins D and I in the viral genome of the recombinant virus.

Humoral Immune Response

Immunogenicity was evaluated through the humoral immune response elicited by the vaccines, sera from chicks were collected and evaluated through an indirect ELISA specific for the detection of glycoprotein I (gI) IDScreen ILT gI Indirect (ID. Vet, Cat. No. ILTGIS) at 1 day of pre-immune age, 21, 34, 42, and 49 days post-immunization.

Relatively high titers were detected at 1 day of age, which correspond to maternal antibodies (Data not shown).

Figure 10A:
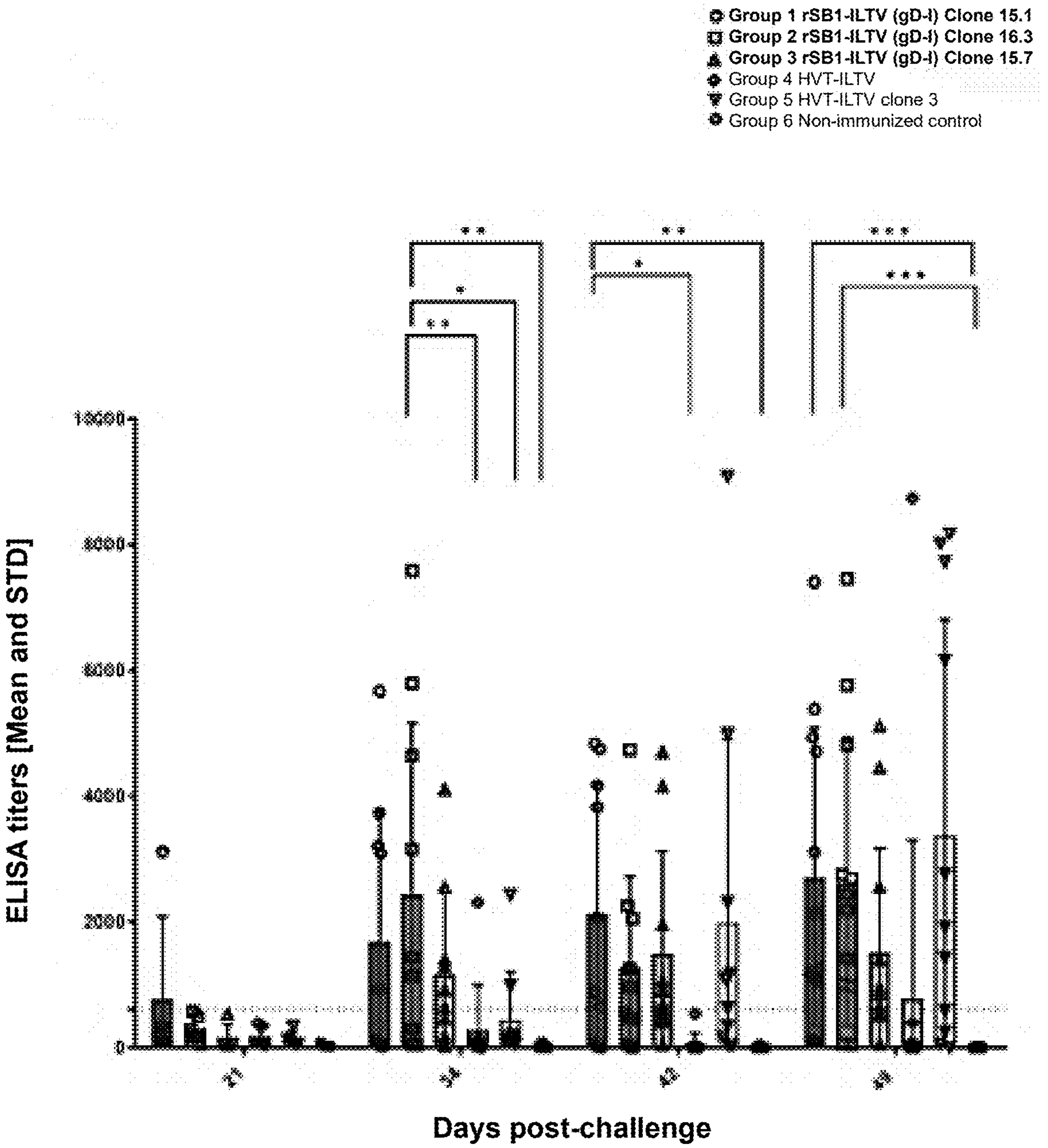
FIG. 10 shows the results of the evaluation of the humoral immune response by a specific ELISA assay to glycoprotein I (gI) IDScreen ILT gI Indirect (ID. Vet, Cat. No. ILTGIS) and the survival percentage of experiment No. 1 in broilers. (A) Antibodies were monitored in serum samples at 21-, 34-, 42-, and 49-days post-immunization, using an ELISA kit specific for glycoprotein I of ILTV. Mean titers and standard deviation are represented by a horizontal bar and whiskers. Positive samples were considered above the cut-off limit (Cut off: ≥611 titer). (B) Score of clinical signs. The groups of birds were challenged with an ILTV strain at 42 days post-vaccination. Subsequently, clinical signs were monitored until day 10 post-challenge. Clinical sign scores were designated as: 0=no clinical signs; 1=conjunctivitis, difficulty breathing, or mild hoarseness; 2=conjunctivitis, difficulty breathing, or moderate hoarseness; 3=conjunctivitis, difficulty breathing, or severe hoarseness. (C) Viral shedding of the challenge virus. Tracheal swabs were collected on days 3, 5, and 7 post-challenge from groups of birds (n=7). The viral load of the challenge virus was determined by quantitative real-time PCR with detection of the ILTV glycoprotein B (gB) gene.

At 21 dpv, one bird from group 1 clone 15.1 demonstrated a high antibody titer, with no significance. On the contrary, at 34 dpv, ELISA results showed statistically significant higher titers in group 1 (clone 15.1) and group 2 (clone 16.3) compared to the unvaccinated group. At 42 dpv, titers were statistically significantly higher in vaccinated groups 1 and 2 compared to the unvaccinated group by two-way ANOVA analysis (FIG. 10A). Results were interpreted as positive at titers 611.

Efficacy in the Face of the ILTV Challenge

The efficacy of the rSB1-ILTV (gD-I) vaccine was evaluated taking into account the clinical signs score and viral shedding.

Figure 10B:
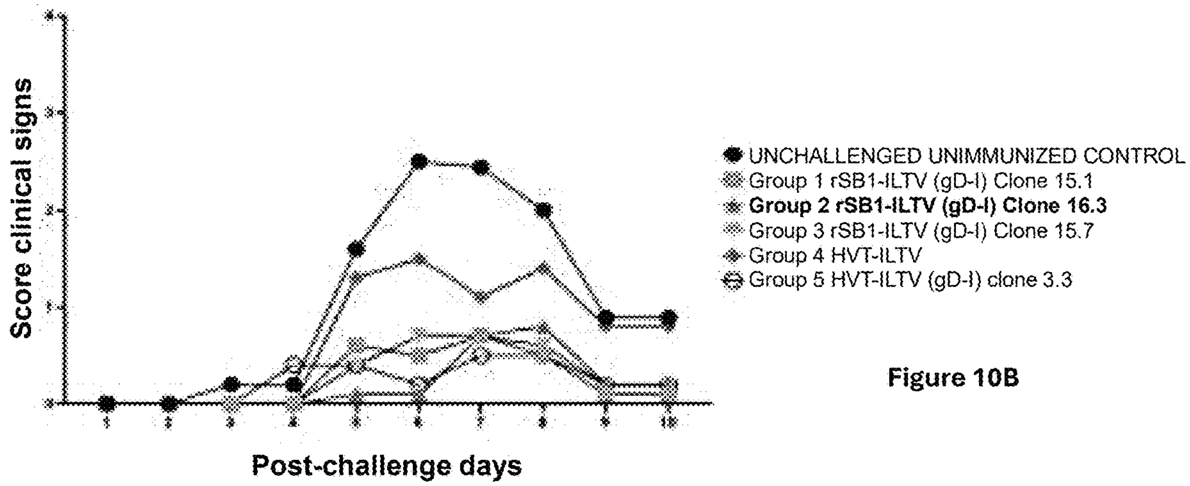

The experimental bird groups were challenged with an infectious laryngotracheitis virus strain at 42 days post-vaccination via ocular (50 μL in each eye) and intratracheal (50 μL) routes and clinical signs were monitored for 10 days. Thereafter, the mean clinical sign scores were higher in the non-immunized bird groups and the group of birds immunized with the rHVT-ILTV vaccine (commercial) which indicated the severity of symptoms in these groups. In addition, it is worth noting that one bird died with severe disease symptoms in the non-immunized group. On the other hand, the groups of birds immunized with the vaccines rSB1-ILTV (gD-I) clone 15.1, rSB1-ILTV (gD-I) clone 16.3, rSB1-ILTV (gD-I) clone 15.7, and rHVT-ILTV isolated showed a lower score of clinical signs with significant difference (FIG. 10B).

Figure 10C:
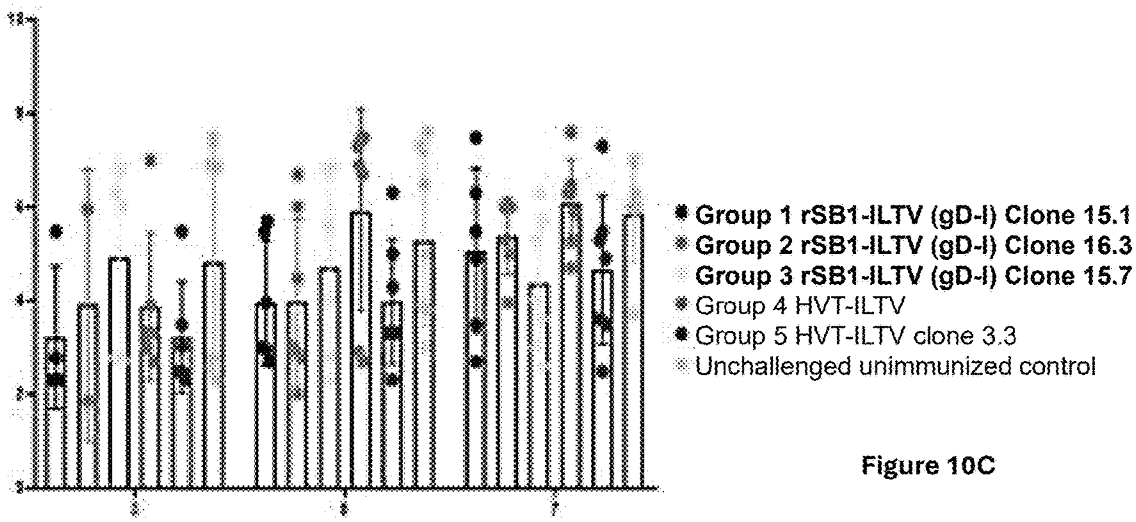

The bird groups in experiment No. 1 were challenged with an infectious laryngotracheitis virus strain at 42 days post-vaccination by ocular (50 μl in each eye) and intratracheal (50 μl) routes. Then, to evaluate the viral dissemination of the challenge virus, tracheal swabs were collected on days 3, 5 and 7 post-challenge to be evaluated by the quantitative real-time PCR technique. Subsequently, the copies/μL averages were higher in the groups of non-immunized birds and the group of birds immunized with the rHVT-ILTV vaccine (commercial), which could indicate a greater viral dissemination in these groups. On the other hand, groups of birds immunized with rSB1-ILTV (gD-I) clone 15.1, rSB1-ILTV (gD-I) clone 16.3, rSB1-ILTV (gD-I) clone 15.7 and rHVT-ILTV (gD-I) isolated vaccines showed a lower average of copies/μl (FIG. 10C).

List of Sequences:

SEQ ID NO.16 Nucleotide sequence of the primer or forward primer SB1_UL45-F in the 5' to 3' direction
Length: 20 bp.

SEQ ID NO.17 Nucleotide sequence of primer or reverse primer SB1_ILTV_UL45-R in the 5' to 3' direction
Length: 20 bp.

SEQ ID NO.18 Nucleotide sequence of the primer or forward primer SB1_EGFP_UL46-F in the 5' to 3' direction
Length: 20 bp.

SEQ ID NO.19 Nucleotide sequence of the primer or reverse primer SB1_ILTV_UL46-R in the 5' to 3' direction
Length: 20 bp.

SEQ ID NO.20 Nucleotide sequence of glycoproteins D and I of ILTV strain VFAR-043, with GenBank accession number: MG775218.1
Length: 3570 bp.

SEQ ID NO.21 Nucleotide sequence of the rSB1-GFP-ILTV (gD-I) virus of strain VFAR-043
Length: 172,133 bp.

SEQ ID NO.22 Nucleotide sequence of the rSB1-ILTV (gD-I) virus of strain VFAR-043
Length: 169,667 bp.

Example 3

Construction, immunogenicity and protective efficacy of *Gallid alphaherpesvirus* 3 (GaHV3) efficiently expressing the Gumboro disease virus (IBDV) glycoprotein VP2 in broilers.

III. Methodology

Animals

One-day-old broilers (Experiment No. 1) were used to evaluate the immunogenicity and efficacy of the rSB1-VP2 vaccine against Gumboro disease virus (IBDV).

Cells and Viruses

For the generation and maintenance of the recombinant virus rSB1-VP2, CEF cells harvested from 9-10-day old SPF embryonated eggs (Charles River Avian Vaccine Services, Norwich, USA) were used. CEFs cells were maintained in DMEM/F12 (Thermo Fisher Scientific) supplemented with 5% inactivated FBS (Thermo Fisher Scientific) and antibiotic-antimycotic 1× (Thermo Fisher Scientific), at 37° C., under 5% $CO_2$ atmosphere.

The GaHV3 or MDV-2 virus strain SB1 (GenBank accession no.: HQ840738.1) (SEQ ID NO.1) was used for the generation of the recombinant virus rSB1-VP2, in CEFs cells by CRISPR/Cas9 technology and by the NHEJ repair pathway.

The IBDV challenge strain used to evaluate the efficacy of the rSB1-VP2 vaccine was the F52/70 strain administered ocularly with a titer of $10^4$ $DIE_{50}$ (30 μl/dose).

Design and Construction

The recombinant virus rSB1-VP2 was obtained by CRISPR/Cas9-NHEJ technology using the plasmids and sgRNAs: pGEM-sgA-GFP-VP2, px459v2.0-sgRNA-sgA, px459v2.0-sgRNA1-SB1/US2, and px459v2.0-sgRNA2-SB1/US2.

Design and Construction of sgRNAs and Donor Plasmid

Selection and Design of sgRNAs

The target sequence in this invention was the US2 gene region of the *Gallid alphaherpesvirus* 3 (MDV-2) genome, which was submitted for gRNA design (http://crispr.mit.edu/), thus selecting 3 sequences with the highest score. The sequences are shown in Table 1.

Plasmid px459v2.0 (catalog no. 62988; Addgene, USA) was digested with BbsI-HF (Neb New England BioLabs, Inc) and then purified using the QIAquick Gel Extraction Kit (Qiagen) following the manufacturer's instructions.

sgRNAs were presented as oligo-DNA primers corresponding to the sgRNA of the target sequence were synthesized and cloned into the previously digested px459v2.0 cloning vector for the construction of px459v2.0-sgRNA. The sequence of sg-A was taken from a previous publication and cloned into the px459v2.0 plasmid in the same way. The correct insertion of the sgRNAs was confirmed by digestion with the enzyme BbsI-HF (data not shown).

Sequence of the US2 gene region in the *Gallid alphaherpesvirus* 3 (strain SB1) genome (SEQ ID NO.33)

```
Size: 816 bp
>tcattcggaagttataactgccgccttcgcacatttctttttgtcctgt

tttgtattgccataacagataggaattgaaacctgatcctcctgtttttt

gcagcatggccagcaacagaatactttgtcggatcgactacttgcgcgag

atggttccgttcttggaggtttcggcgggtcgggtggagaacctattatt

ttatacacacacgtcataccgttgtcgcgaaaatgttctttgtcttctgc

cgtctcgaacgtcggttcccacgtagacgttaggagcgttggaatggtat

caggaagagcccacggcatgccggaccaagtacccgctactttgaccgcg

agcagtctcttcggtaatgggatgtattccagagcagcgcggcagagatc

agcggcccccactatccacagactgtatgaagtgttttctgaaacatcgg

actccaacatcaaatatccagacataacatcttgccattcggaagcacat

ccgccgacatcttcaaatagcctaactataaacgagtctctagttcctgc

taacccagtacctcgaatgccagtcccatccggtgggttcgtcctgataa

tcggtctctgacgccgaggaagaactaaaaggggtctggaaaagcggaac

agatctgcagaccgaacgactacagacacgcccacatcatcatgtatctg

ttccatgcattgctttatgagaaaaatccataaggccgaggcggcatctc

tagatctcccggggagtctctcgcactcatctaggagagtgacgacagtt

atcatagacacgcccat
```

TABLE 1

Sequences of sgRNAs designed based on the 816 bp sequence of the US2 gene region of the *Gallid alphaherpesvirus* 3 (strain SB1) genome (GenBank accession no.: HQ840738.1) https://www.ncbi.nlm.nih.gov/nuccore/HG974565.1

| # | sgRNA | 5'----------------------------3' | |
|---|---|---|---|
| 1 | gRNA1_US2/SB1_T | CACCGAGAAAAATCCATAAGGCCG | gT(+) |
| | gRNA1_US2/SB1_B | AAACCGGCCTTATGGATTTTTCTC | gB(-) |
| 2 | gRNA2_US2/SB1_T | CACCGGAATGCCAGTCCCATCCGG | gT(+) |
| | gRNA2_US2/SB1_B | AAACCCGGATGGGACTGGCATTCC | gB(-) |

sgRNA cloning procedure

Hybridization of sgRNAs

The sgRNA was synthesized as oligo:

5'CACCNNNNNNNNNNNNNNNNNNNNNNNNNNNNNNNNNNNNNNNNNNCAAA 5'

*The sgRNA was resuspended in nuclease-free water and diluted 1/10 to have a final working concentration of 10 μM.

1× hybridization reaction:

| Hybridization reaction | Volume |
|---|---|
| Hybridization buffer solution 1× | 2 μl |
| sgRNA upper DNA chain (10 μM) | 2 μl |
| sgRNA lower DNA chain (10 μM) | 2 μl |
| $H_2O$ | 14 μl |
| TOTAL | 20 μl |

*Hybridization buffer solution: 10 mM Tris, pH 7.5-8; 50 mM NaCl, 1 mM EDTA.

The samples were placed in the thermocycler under the following conditions:

90° C. for 3 min and 37° C. for 1 hour.

The samples were quantified by spectrophotometry using Eppendorf BioPhotometer plus, obtaining an average value of 200 ng/μl. A 1/10 dilution was performed to have a working stock of 20 ng/μl.

Digestion or Linearization of the Plasmid Vector PX459-v2.0 (Catalog No. 62988; Addgene, USA)

| Digestion reaction 1×: | | |
|---|---|---|
| Digestion reaction | Reaction 1× | Volume |
| CutSmart Buffer Solution 10× | 1× | 2 μl |
| BbS I-HF enzyme (20 000 U) | 20 units | 1 μl |
| Plasmid (500 ng/ml) | 2 μg | 4 μl |
| $H_2O$ | | 12 μl |
| TOTAL | | 20 μl |

The samples were placed in the thermocycler at 37° C. for 6 hours.

An electrophoresis assay was performed to purify the band of interest, which contains linear DNA. The gel was cut and the DNA was extracted using the QIAquick® Gel Extraction Kit 250. The linearized DNA was quantified and stored at 4° C.

Ligation of sgRNAs with the PX459-v2.0 Vector

The protocol described by NEB (Quick ligation protocol—M2200) was followed.

| Ligation reaction 1×: | | |
|---|---|---|
| Ligation reaction | Reaction 1× | Volume (20 μl) |
| Ligase buffer solution 2× | 1× | 10 μl |
| sgRNA (20 ng/μl) | 3× (75 ng) | |
| Plasmid | 1× (25 ng) | |
| Ligase | 1× | 1 μl |
| $H_2O$ | | Up to 20 μl |
| TOTAL | | 20 μl |

The ligation products (sgRNA+vector px459-v2.0) that gave rise to the new plasmids were identified:

| Name of gRNAs cloned in px459-v2.0 |
|---|
| px459v2.0-sgRNA1-SB1/US2 |
| px459v2.0-sgRNA2-SB1/US2 |

Both px459v2.0-sgRNA1-SB1/US2 and px459v2.0-sgRNA2-SB1/US2 were selected for the following cloning steps.

Transformation into Competent *E. coli* DH5a Bacteria with the Ligation Product to Obtain the Recombinant Plasmid Px459v2.0-sgRNA1-SB1/US2 and px459v2.0-sgRNA2-SB1/US2

The ligation product (sgRNA+px459-v2.0 vector) was added onto competent *E. coli* DH5a cells, followed by heat shock from 4° to 42° C.

The transformed bacteria were grown in LB broth supplemented with the antibiotic ampicillin (100 μg/ml) and transferred by plating onto LB agar plates supplemented with ampicillin (100 μg/ml) for subsequent selection of clones (recombinant plasmids).

Extraction and Purification of the Recombinant Plasmid px459v2.0-sgRNA1-SB1/US2 and px459v2.0-sgRNA2-SB1/US2

Recombinant plasmids were selected, grown in LB broths supplemented with ampicillin (100 μg/ml), the bacterial pellet was concentrated, and the plasmid was extracted using the QIAprep® Spin Miniprep Kit (250) extraction kit, according to the manufacturer's instructions, using the QIAcube equipment and the correct insertion of the sgRNA into the plasmid pX459-v2.0 was verified through the digestion product with the BbsI-HF digestion enzyme in the 1% agarose gel electrophoresis run. Finally, the US2-specific sgRNA from SB1 was named: px459v2.0-sgRNA1-SB1/US2 and px459v2.0-sgRNA2-SB1/US2.

Design and Construction of the Donor Plasmid

For the construction of the donor plasmid, two consecutive cloning processes were performed: the open reading frame (ORF) of the IBDV VP2 gene (GenBank accession number: HG974565.1) (SEQ ID NO. 34), which is flanked at both ends by the SfiI restriction site (upstream and downstream). This sequence was subsequently synthesized and cloned into plasmid pUC57 by GenScript, the resulting plasmid was named pUC57-VP2.

The plasmid pGEM-sgA-GFP, previously constructed. This plasmid was digested and linearized by the enzyme SfiI. The plasmid pGEM-sgA-GFP (this plasmid contains: sgA+murine cytomegalovirus promoter+Sfi cleavage sites+a SV40 Poly A signal sequence+a GFP expression cassette for the expression of the fluorescence reporter gene, the latter flanked by LoxP+sgA sequences).

The plasmid pUC57-VP2 was digested by the enzyme SfiI to release the VP2 cassette, then this cassette was cloned into the plasmid pGEM-sgA-GFP (linearized), the resulting plasmid was named pGEM-sgA-GFP-mCMV-VP2-Poly A (8586 bp).

The correct insertion and orientation of the IBDV expression cassette (VP2) was verified by PCR using specific primers and by sequencing (data not shown).

TABLE 8

| List of primers and sgRNAs used in this invention study | | | |
|---|---|---|---|
| *Gallid alphaherpesvirus* (GaHV-3) primers and sgRNAs | Direction | Sequences (5'-> 3') | SEQ No. |
| MDV2-US2-5F | Forward primer | GGTATCAGGAAGAGCCCACG | SEQ ID NO.23 |
| MDV2-US2-5R | Reverse primer | GATCTAGAGATGCCGCCTCG | SEQ ID NO.24 |
| MDV2-US2-6F | Forward primer | TGTCGGATCGACTACTTGCG | SEQ ID NO.25 |
| MDV2-US2-VP2-6R | Reverse primer | CCCTGAAGATTGCAGGAGCA | SEQ ID NO.26 |
| MDV2-EGFP-US2-7F | Forward primer | CCACTCCCACTGTCCTTTCC | SEQ ID NO.27 |

TABLE 8-continued

List of primers and sgRNAs used in this invention study

| *Gallid alphaherpesvirus* (GaHV-3) primers and sgRNAs | Direction | Sequences (5'-> 3') | SEQ No. |
|---|---|---|---|
| MDV2-US3-7R | Reverse primer | TGTCTTCGACGTTCGTCTGG | SEQ ID NO.28 |
| gRNA1_US2/SB1_T | Upper chain | CACCGAGAAAAATCCATAAGGCCG | SEQ ID NO.29 |
| gRNA1_US2/SB1_B | Lower chain | AAACCGGCCTTATGGATTTTTCTC | SEQ ID NO.30 |
| gRNA2_US2/SB1_T | Upper chain | CACCGGAATGCCAGTCCCATCCGG | SEQ ID NO.31 |
| gRNA2_US2/SB1_B | Lower chain | AAACCCGGATGGGACTGGCATTCC | SEQ ID NO.32 |

Generation of the Recombinant rSB1-GFP-VP2

$0.5\times10^6$ CEF cells were seeded per well in a 6-well cell culture plate in maintenance medium (DMEM 1×+5% FBS) at 37° C. under 5% $CO_2$ atmosphere. After 24 hours, the supernatant was removed and the monolayer was washed 3 consecutive times with DPBS 1× to remove cell debris. Cells were infected with SB1wt with MOI of 0.01 for 8 hours at 37° C. and 5% $CO_2$ in medium DMEM 1×+5% FBS.

The next day, 1 μg of plasmid pGEM-sgA-GFP-mCMV-VP2-Poly A containing the mCMV-VP2-Poly A cassette, 0.5 μg of sgRNA-sgA, and 0.5 μg sgRNA SB1 US2, were co-transfected for 24 hours using Lipofectamine® Reagent (Thermo Fisher Scientific) following the manufacturer's instructions.

At 24 hours post-transfection, the supernatant containing the DNA complex: Lipofectamine was removed and replaced with fresh maintenance medium, to avoid any toxicity to the cell monolayer.

At three days post transfection, infected/transfected cells were transferred and distributed into 4 6-well CEF cell culture plates previously seeded.

At four days post-transfection/infection, plaques emitting GFP fluorescence were visible, corresponding to the recombinant virus. The selected clones were then purified with three rounds of plaque purification (sub-clones). For this, single cells expressing the VP2-GFP expression cassette were selected and distributed in 96-well cell culture plates by FACS on a BD FACSMelody™ Cell Sorter (BD Biosciences). Finally, the new recombinant virus was named rSB1-GFP-VP2 (SEQ ID NO. 35). Subsequently, the presence and expression of the VP2 cassette (IBDV) was verified by conventional PCR and IIF.

Selection of rSB1-GFP-VP2 Recombinant Clones

Recombinant clones of rSB1-GFP-VP2 were evaluated by conventional PCR to confirm the correct insertion of the VP2/GFP cassette into the SB1 genome post-transfection and purification. Five clones were selected and infected into previously seeded CEF cells, then trypsinized upon reaching a 70% infection rate. Viral DNA was extracted and analyzed by conventional PCR using the following specific primers, see Table 3.

Removal of the GFP Reporter Cassette by the Cre-Lox System

The GFP expression cassette (flanked by LoxP sequences) from rSB1-GFP-VP2 was removed by the Cre-Lox system. A monolayer of CEF cells was prepared in a 6-well cell culture plate and then infected with rSB1-GFP-VP2 virus with MOI of 0.01 for 24 hours. The infected monolayer was then co-transfected with 2 μg of Cre recombinase using Lipofectamine® Reagent (Thermo Fisher Scientific) following the manufacturer's instructions.

After 12 hours post-transfection the culture medium was changed to avoid any cytotoxic effect. Verification of the complete removal of the GFP reporter gene expression cassette was confirmed by the appearance of new non-fluorescent lysis plaques. Finally, the new recombinant virus obtained was named rSB1-VP2 (SEQ ID NO. 36).

Selection of Recombinant rSB1-VP2 Clones Post-Removal of the GFP Reporter Cassette Verification of the complete removal of the GFP reporter cassette in the rSB1-GFP-VP2 clones was verified by conventional PCR using specific primers (see Table 3). Likewise, these same primers allowed the integrity of the IBDV VP2 expression cassette in SB1 to be evaluated.

Indirect Immunofluorescence Assay (IIF)

CEF cells were grown in 6-well cell culture plates and infected with MOI of 0.001 with SB1wt and rSB1-VP2. After 48 hours post-infection (hpi), cells were washed three times with 1×DPBS and then fixed with 4% paraformaldehyde for 30 min at room temperature. Cells were incubated with the primary antibody in a solution of 5% bovine serum albumin (BSA) in DPBS for 1 hour at room temperature. A primary antibody: anti-serum of Infectious Bursal Disease Virus (catalog no. #G0114) (Avian Vaccine Services, LLC dba AVS Bio, Norwich, USA) was used to detect VP2 expression. After three washes with DPBS 1×, cells were incubated with a goat anti-chicken IgY secondary antibody H&L Alexa Fluor®594 at a dilution of 1:200 (catalog no. ab150172, Abcam, Cambridge, MA, USA) (red fluorescence), respectively, in 1×DPBS with 5% BSA for 1 h at room temperature. Results were observed using an ObserverA1 fluorescence microscope (Carl Zeiss, Germany). Digital images were taken at 200× magnification and processed with an AxioCam MRc5 camera (Carl Zeiss, Germany).

Western Blotting for Detection of VP2 Protein in rSB1-VP2

To assess VP2 protein expression, CEF cells were infected with the recombinant virus with MOI of 0.01. At 72 hpi, CEF cells were lysed and analyzed by Western blotting. Western blot analysis was performed using an Anti-IBDV primary antibody, VP2 Mouse (Catalog No. MBS312798, MyBioSource) diluted 2/5000 in 1% milk in 0.1% PBS-T for 15 hours at room temperature with constant agitation. Subsequently, three washes were performed with 0.1% T-TBS (each wash for 10 min with constant agitation). After finishing the washes, the membrane was incubated with the secondary antibody Anti-Mouse IgG [HRP](Catalog No.

A00160, GenScript, Piscataway, NJ, USA) diluted 2/5000 in 1% milk in 0.1% PBS-T for 2 hours at room temperature with constant agitation.

Visualizations of protein expression were detected using a photodocumenter and an AZURE CCD camera (Azure Biosystems, Inc., Dublin, USA).

Experimental Design No. 1: Immunization of Broilers with the rSB1-VP2 Vaccine

For the immunization experiment, three sub-clones of recombinant virus obtained from rSB1-VP2 clones were evaluated: 3.2, 3.7 and 18.7; a non-immunized control group was used as a control.

| Age | Group A | Group B | Group C | Group D |
|---|---|---|---|---|
| 1 day | rSB1-VP2 C 3.2 n = 12 | rSB1-VP2 C3.7 n = 12 | rSB1-VP2 C18.7 n = 12 | Non-immunized control n = 12 |

Chicks were immunized with a dose of 3000 PFU/bird, at 20, 34, and 42 days post-immunization, serum samples were collected to evaluate the humoral immune response by detecting antibodies against the IBDV VP2 protein, using an indirect ELISA IDScreen® IBD VP2 Indirect (ID. Vet Cat. No IBDVP2).

Study assessment schedule:

| | Group | | | |
|---|---|---|---|---|
| | A | B | C | D |
| | No. of birds (n) | | | |
| | 12 | 12 | 12 | 12 |
| Days | Treatment | | | Control |
| 1 | Subcutaneous immunization with 3000 PFU/Chick | | | Not applicable |
| 20 | Serological evaluation by indirect ELISA IDScreen ® IBD VP2 Indirect | | | |
| 34 | Serological evaluation by indirect ELISA IDScreen ® IBD VP2 Indirect | | | |
| 41 | Serological evaluation by indirect ELISA IDScreen ® IBD VP2 Indirect | | | |
| 42 | Challenge: 30 μl ($10^4$ $DIE_{50}$) of a classical strain F52/70 via ocular | | | |
| 45 | Evaluation of macroscopic and microscopic lesions post-challenge | | | |
| 48 | Evaluation of macroscopic and microscopic lesions post-challenge | | | |
| 52 | Evaluation of macroscopic and microscopic lesions post-challenge | | | |

At 35 days of age all birds were challenged with the F52/70 strain via ocular with a titer of $10^4$ $DIE_{50}$ (30 μl/dose).

Following challenge, birds were clinically examined for 10 days, recording mortality, depression, diarrhea, and any other clinical signs. Dead birds were necropsied to determine and confirm the cause of death.

Evaluation of Macroscopic and Microscopic Lesions

For the evaluation of macroscopic and microscopic lesions, 3 birds per group were sacrificed at 45, 48, and 52 days of age; in all cases the macroscopic and microscopic lesions found were recorded and photographed.

Bursal Index:

The bursal index was determined, i.e., the weight of the Bursa of Fabricius with respect to body weight, which is used to determine the presence or absence of atrophy of the Bursa of Fabricius.

The formula is:

$$\frac{\text{Bursa weight (g)} \times 1000}{\text{Body weight (g)}}$$

The obtained bursal index was classified as follows:

1.5-3.5=Normal Bursa 0.5-1.5=Bursal Atrophy

≤a 0.5=Severe Bursal Atrophy

Statistical Analysis

Results:

Construction and Recovery of the Recombinant Virus

The sgRNAs (sgRNA-sgA and sgRNA-US2) were designed, synthesized, and cloned into plasmid px459v.20, which contains the *S. pyogenes* Cas9 gene. The resulting plasmids were named px459v2.0-sgRNA-sgA and px459v2.0-sgRNA-US2.

Figure 11:
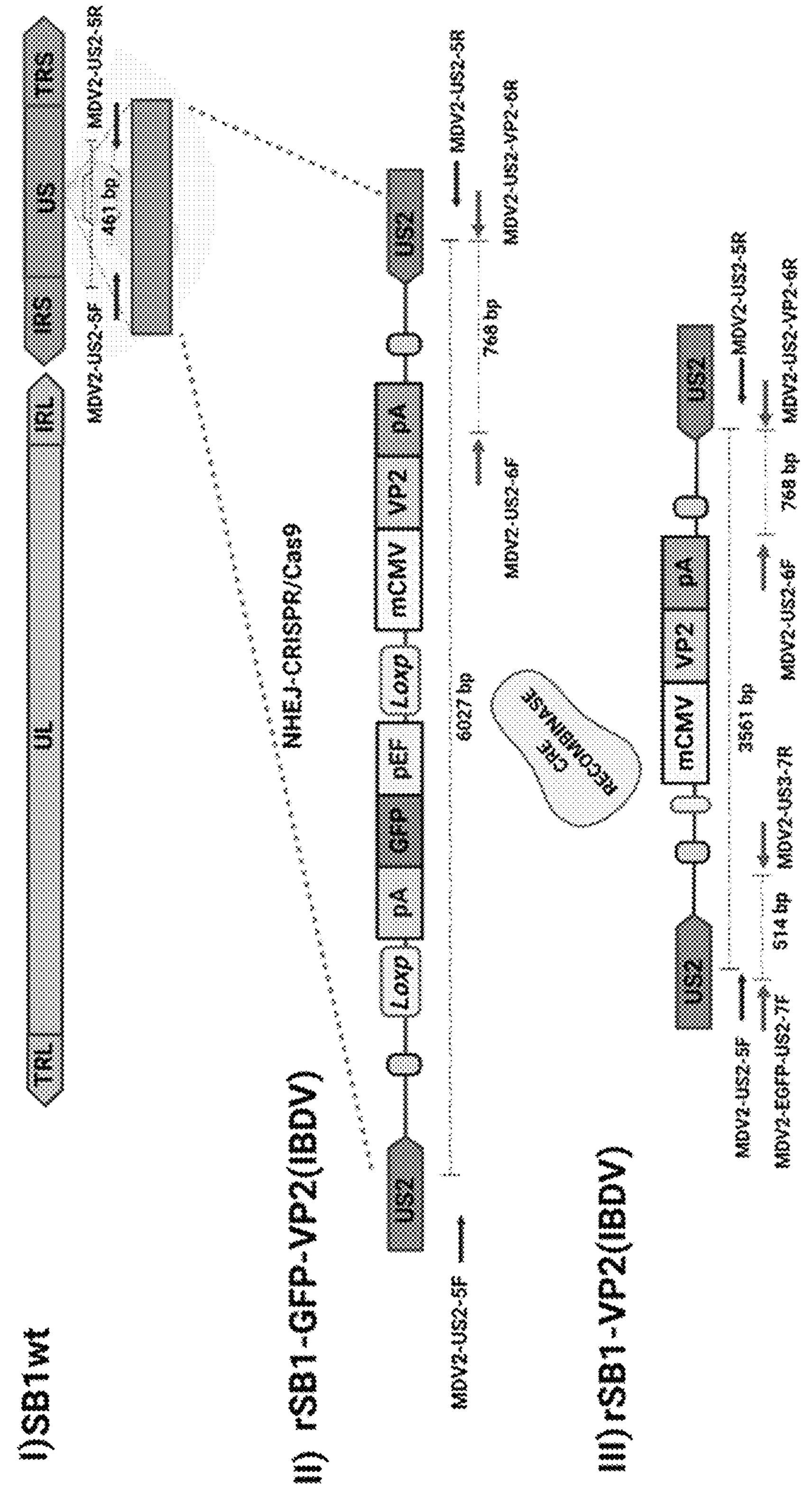
FIG. 11 shows the strategy used for the generation of the rSB1-VP2 virus by CRISPR/Cas9-NHEJ technology, using two sgRNAs from the US2 gene region (SB1 sg1/US2 and SB1 sg2/US2). The genome of the parental virus, or SB1wt, is shown with a unique long region (UL), a unique short region (US), and a long (TRL/IRL) and short (TRS/IRS) internal repeat region. Strategy used for the generation of rSB1-VP2 by CRISPR/Cas9– NHEJ. This figure was created with BioRender.com (Figure not scaled).

The donor plasmid pGEM-sgA-GFP-mMCV-VP2-Poly A contains the GFP reporter expression cassette which is flanked by two LoxP sequences for its separation from the VP2 expression cassette. The two cassettes were flanked by sg-A sites to introduce a desired cleavage for the release of the cassette and integration into the US2 intergenic region of the SB1wt genome. The Cas9 endonuclease promotes the insertion of the GFP cassette and VP2 gene into the genic region of the SB1wt genome, see FIG. 11.

For generation of rSB1-GFP-VP2 virus, CEF cells were co-transfected with plasmids pGEM-sgA-GFP-mMCV-VP2-Poly A, px459v2.0-sgRNA-sgA, px459v2.0-sgRNA1-US2, and px459v2.0-sgRNA2-US2. At 24 h post-transfection, cells were infected with SB1wt virus with MOI of 0.01. Plaques expressing GFP were visible at 4 days post-transfection/infection, demonstrating successful cassette insertion. Recombinant virus was isolated in three rounds of purification by plaque isolation and Cell Sorter.

Figure 12:
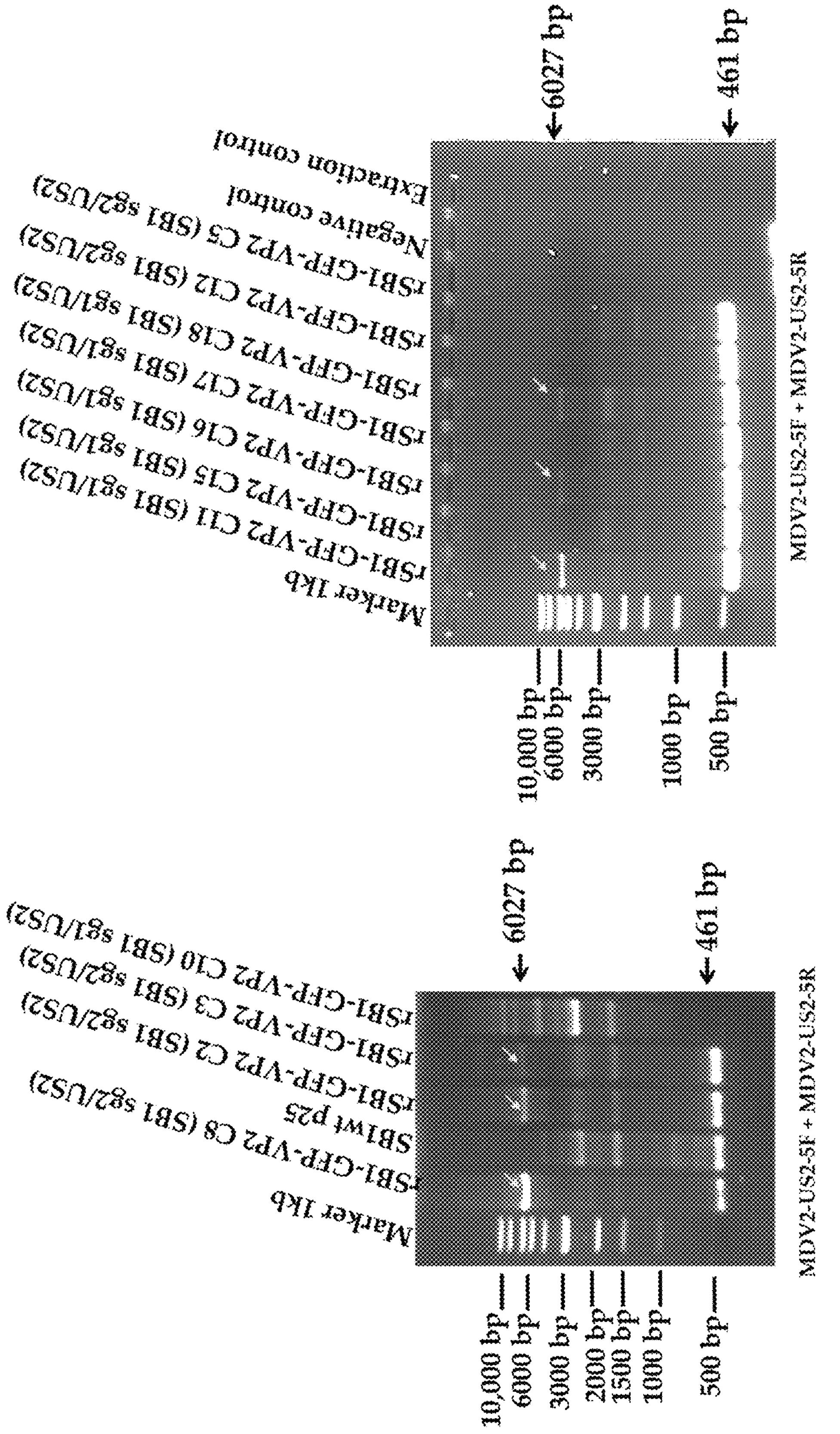
FIG. 12 shows the evaluation and selection of recombinant clones by conventional PCR of rSB1-GFP-VP2 obtained from the transfection. Recombinant clones: C10, C11, C15, C16, C17, and C18 (corresponding SB1 sg1/US2), clones C2, C3, C5, C8, and C12 (corresponding SB1 sg2/US2), were evaluated by PCR with specific primers MDV2-US2-5F+MDV2-US2-5R that amplify the flanking region of the reporter cassette, the product amplified an expected band of 6027 bp.
Figure 13:
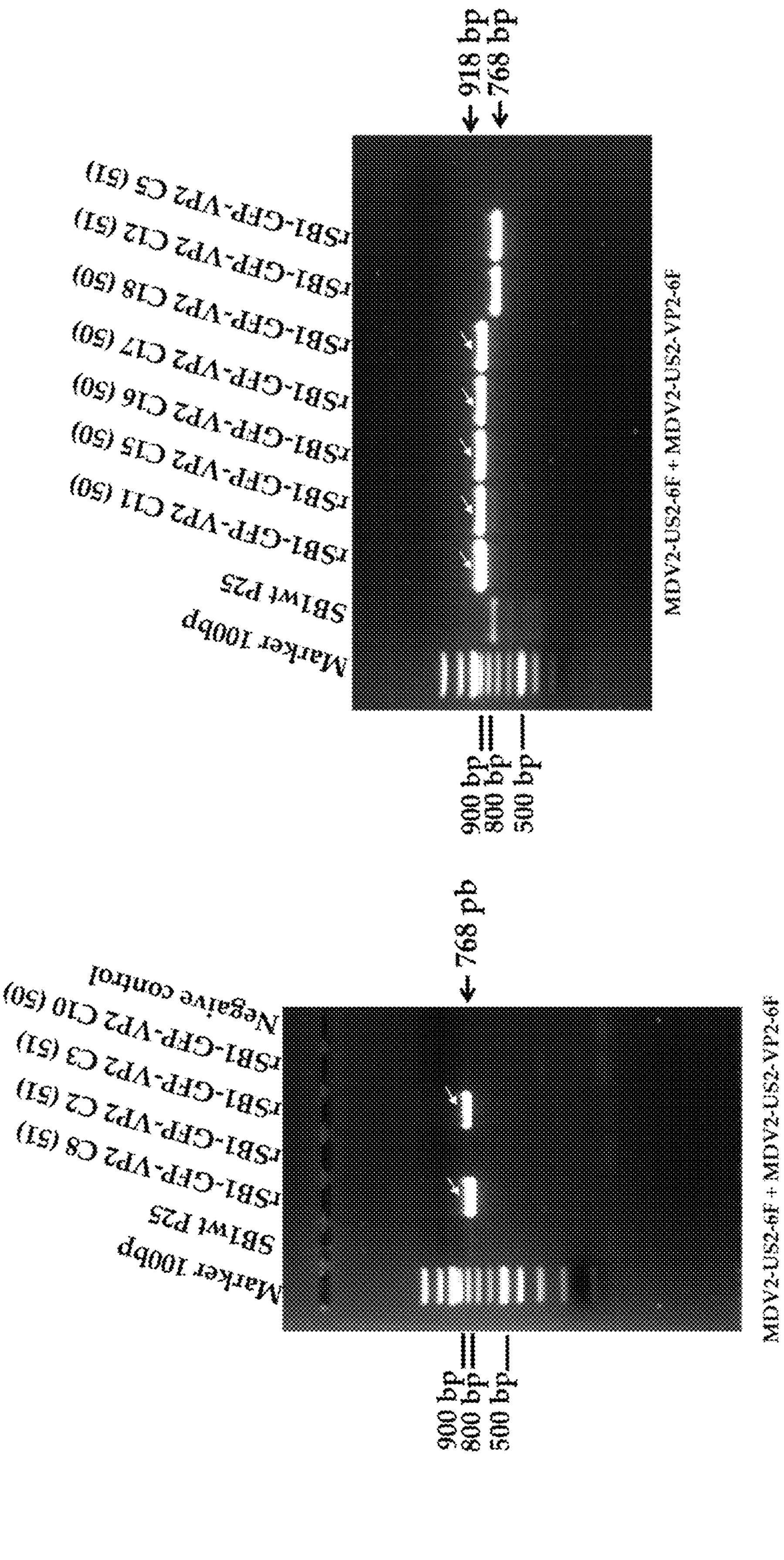
FIG. 13 shows the evaluation and selection of recombinant clones by conventional PCR of rSB1-GFP-VP2 obtained. Recombinant clones: C10, C11, C15, C16, C17, and C18 (corresponding SB1 sg1/US2 (50)), clones C2, C3, C5, C8, and C12 (corresponding SB1 sg2/US2 (51)), were evaluated by PCR with specific primers MDV2-US2-6F+MDV2-US2-VP2-6R that amplify the junction region between the expression cassette and the vector genome, the amplified products showed a band size of 918 and 768 bp respectively.
Figure 14:
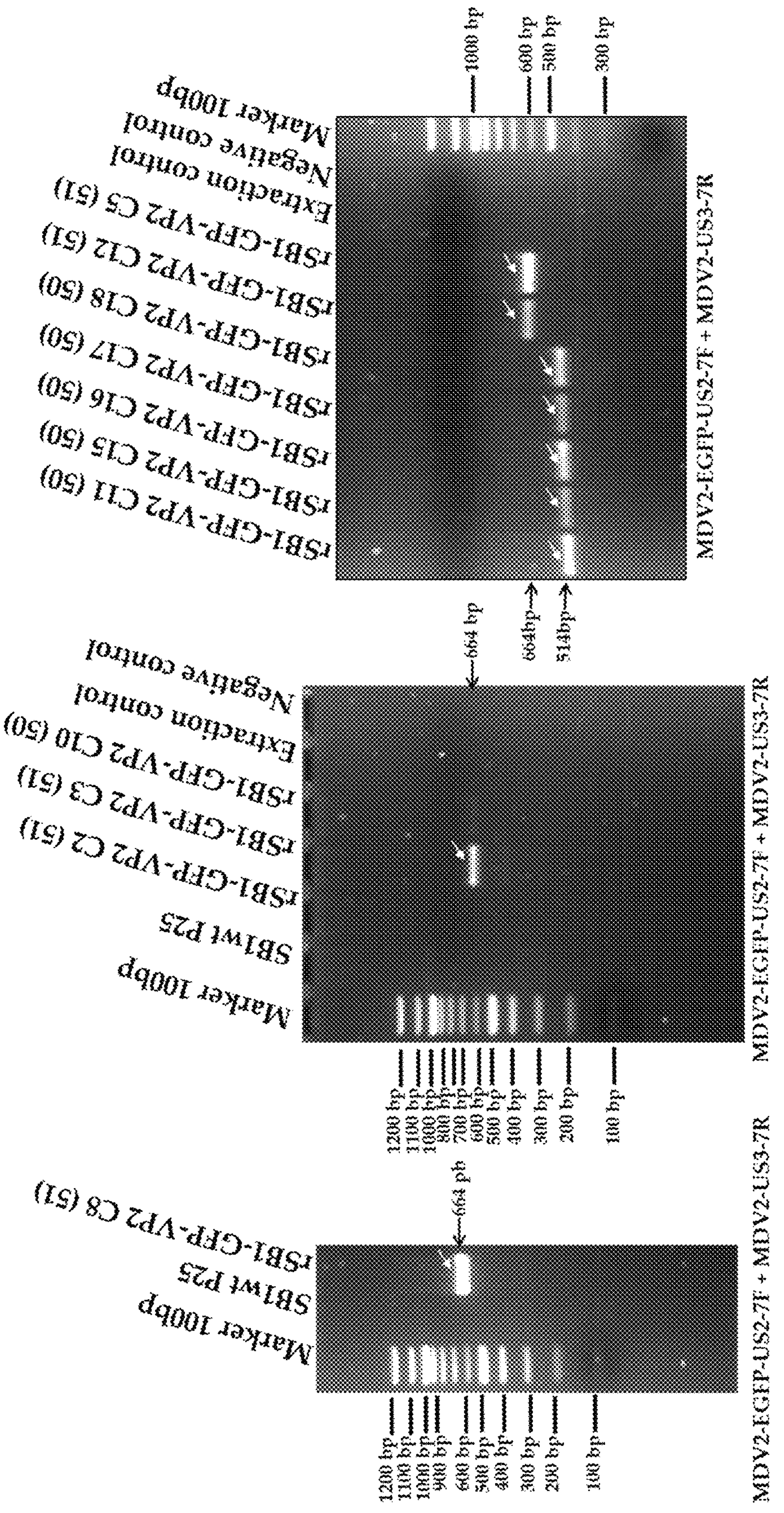
FIG. 14 shows the evaluation and selection of recombinant clones by conventional PCR of rSB1-GFP-VP2 obtained. Recombinant clones: C10, C11, C15, C16, C17, and C18 (corresponding SB1 sg1/US2 (50)), clones C2, C3, C5, C8, and C12 (corresponding SB1 sg2/US2 (51)), were evaluated by PCR with specific primers MDV2-EGFP-US2-7F+MDV2-US3-7R that amplify the joining region between the expression cassette and the vector genome, the amplified products showed a band with a size of 514 and 664 bp respectively.

Subsequently, the removal of the GFP reporter cassette was performed with Cre-recombinase (pcDNA3.1-Cre) treatment through Cre-LoxP system. Cells infected with rSB1-GFP-VP2 virus were transfected with Cre-recombinase, and lysis plaques without fluorescence emission were visible 4 days post-transfection/infection. Complete removal was confirmed by applying various conventional PCRs using specific primers that amplified the entire region and the insert-joining ends of the virus genome (FIGS. 12, 13, and 14). Finally, the new recombinant SB1 was named rSB1-VP2.

Selection of Clones after Removal of GFP Reporter Cassette

Prior to removal of the reporter cassette, rSB1-GFP-VP2 virus clones C3, C8, C11, C16, and C18 were selected for removal because they presented a DNA band size of 6855 bp by conventional PCR, which indicated the presence of both the GFP reporter cassette and the VP2 cassette.

After removal of the GFP reporter cassette, five recombinant clones rSB1-VP2 were selected, from which the complete removal of the GFP reporter cassette was verified, using a conventional PCR, see Table 3, demonstrating the complete removal of the reporter cassette and integrity of the VP2 cassette in the US2 gene region of the *Gallid alphaherpesvirus* 3 (SB1) genome.

Detection of VP2 Expression in rSB1-VP2

Figure 15:
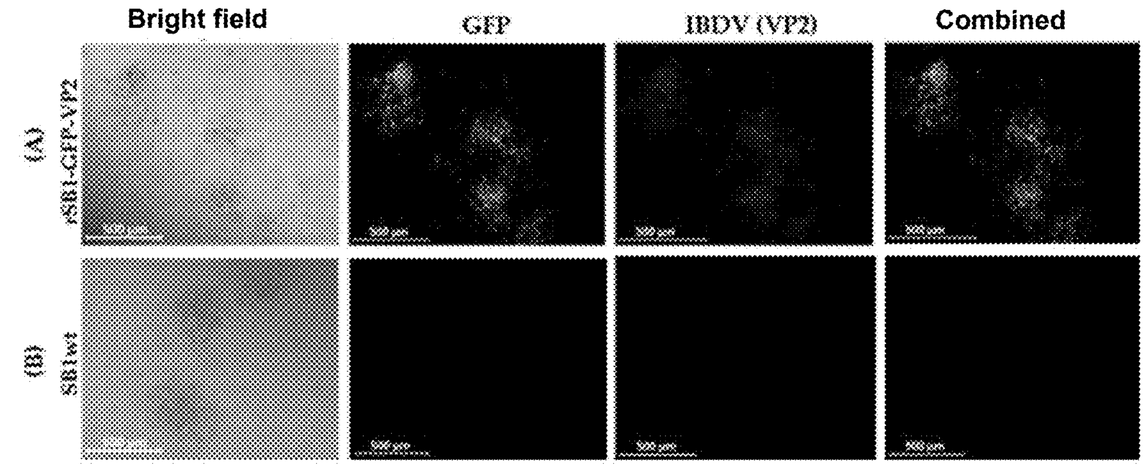
FIG. 15 shows the in vitro evaluation of the stability of the expression cassette containing the gene encoding the VP2 protein in the *Gallid alphaherpesvirus* 3 genome. CEF cells were infected with the rSB1-GFP-VP2 virus. The IIF assay demonstrated the expression of the VP2 gene (red fluorescence) in cells infected with the recombinant rSB1-GFP-VP2 virus. CEF cells infected with SB1wt were used as a negative control. Digital images were captured at 200× magnification and processed with the AxioCam MRc5 camera (Carl Zeiss, Germany).
Figure 16:
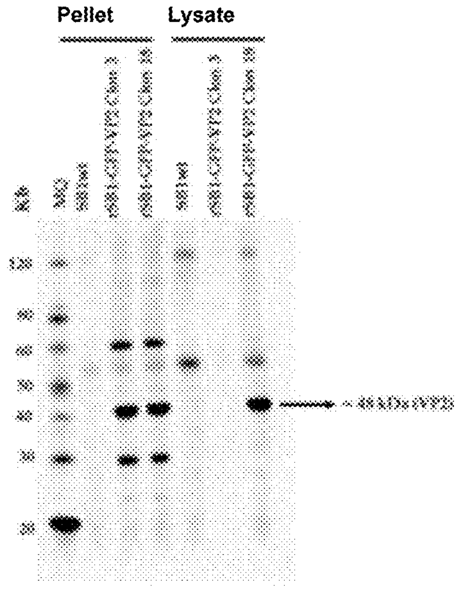
FIG. 16 shows the expression of IBDV VP2 protein in CEF cells infected with rSB1-GFP-VP2 (IBDV). Cells were infected with MOI of 0.0001 of rSB1-GFPVP2 and SB1wt. After 48 hours, cell lysates were collected and analyzed by Western blotting, detecting a band of ~48 kDa (VP2). CEF cells infected with SB1wt were used as a negative control for the experiment, in which no band was detected.

Expression of VP2 protein was confirmed by Western blotting with a 45 kDa band. CEF cells infected with SB1wt and uninfected cells were used as negative controls for the experiment, in which no band was detected (FIG. 16). IIF demonstrated expression of VP2 protein in CEF cells infected with the recombinant virus (FIG. 15). These results demonstrated that the presence and expression of the IBDV VP2 gene did not affect the replication of the recombinant virus.

Humoral Immune Response and Protection

From the third week post-immunization, antibody levels in immunized birds were measured and detected. After challenge with IBDV, all groups of birds except the non-immunized control group showed 100% protection against IBDV. Therefore, these studies demonstrate that this new recombinant *Gallid alphaherpesvirus* 3 vaccine vector induces similar antibody levels as other conventional commercial vaccines. The average clinical score and the survival percentage of birds during the IBDV challenge evaluation indicated the efficacy of the recombinant vaccine in immunized birds. The results show that GaHV-3 can be used as a vaccine vector against IBDV disease expressing the VP2 protein in one-day-old chicks, resulting in 100% protection against challenge with a lethal dose of IBDV.

Post-challenge mortality rate for both groups

| | | Days post challenge | | | | | |
|---|---|---|---|---|---|---|---|
| | Group | 1 | 2 | 3 | 4 | 5 | 6 |
| A | Dead birds | 0 | 0 | 0 | 0 | 0 | 0 |
| | % mortality | 0 | 0 | 0 | 0 | 0 | 0 |
| B | Dead birds | 0 | 0 | 0 | 0 | 0 | 0 |
| | % mortality | 0 | 0 | 0 | 0 | 0 | 0 |
| C | Dead birds | 0 | 0 | 0 | 0 | 0 | 0 |
| | % mortality | 0 | 0 | 0 | 0 | 0 | 0 |
| D | Dead birds | 0 | 0 | 2 | 3 | 3 | 4 |
| | % mortality | 0 | 0 | 16.6% | 41.6% | 66.6% | 100% |

List of Sequences:

SEQ ID NO.23 Nucleotide sequence of the primer or forward primer MDV2-US2-5F in the 5' to 3' direction Length: 21 base pairs.

SEQ ID NO.24 Nucleotide sequence of the primer or reverse primer MDV2-US2-5R in the 5' to 3' direction Length: 20 base pairs.

SEQ ID NO.25 Nucleotide sequence of the primer or forward primer MDV2-US2-6F in the 5' to 3' direction Length: 20 base pairs.

SEQ ID NO.26 Nucleotide sequence of the primer or reverse primer MDV2-VP2-6R in the 5' to 3' direction Length: 20 base pairs.

SEQ ID NO. 27 Nucleotide sequence of the primer or reverse primer MDV2-EGFP-US2-7F in the 5' to 3' direction Length: 20 base pairs.

SEQ ID NO. 28 Nucleotide sequence of the primer or reverse primer MDV2-US3-7R in the 5' to 3' direction Length: 20 base pairs.

SEQ ID NO.29 Nucleotide sequence of the upper chain oligo gRNA1_US2/SB1_T

Length: 24 bp.

SEQ ID NO.30 Nucleotide sequence of the lower chain oligo gRNA1_US2/SB1_B Length: 24 bp.

SEQ ID NO.31 Nucleotide sequence of the upper chain oligo gRNA2_US2/SB1_T

Length: 24 bp.

SEQ ID NO.32 Nucleotide sequence of the lower chain oligo gRNA2_US2/SB1_B

Length: 24 bp.

SEQ ID NO.33 Gene sequence of US2 of *Gallid alphaherpesvirus* 3 with GenBank accession number Accession number: HQ840738.1

Length: 816 bp.

SEQ ID NO.34 Nucleotide sequence of the VP2 glycoproteins of IBDV strain Faragher 52/70, with GenBank accession number: Y14958.1

Length: 1362 bp.

SEQ ID NO.35 Nucleotide sequence of the rSB1-GFP-VP2 virus (IBDV)

Length: 171,562 bp.

SEQ ID NO.36 Nucleotide sequence of rSB1-VP2 virus (IBDV)

Length: 169,094 bp.

REFERENCES

1. Jarosinski K W, Tischer B K, Trapp S, Osterrieder N. 2006. Marek's disease virus: Lytic replication, oncogenesis and control. Expert Review of Vaccines 5:761-772.
2. Petherbridge L, Xu H, Zhao Y, Smith L P, Simpson J, Baigent S, Nair V. 2009. Cloning of *Gallid herpesvirus* 3 (Marek's disease virus serotype-2) genome as infectious bacterial artificial chromosomes for analysis of viral gene functions. Journal of Virological Methods 158:11-17.
3. Kim T, Spatz S J, Dunn J R. 2020. Vaccinal efficacy of molecularly cloned *Gallid alphaherpesvirus* 3 strain 301B/1 against very virulent Marek's disease virus challenge. Journal of General Virology 101:542-552.
4. Iqbal M. 2012. Progress toward the development of polyvalent vaccination strategies against multiple viral infections in Chickens using herpesvirus of turkeys as vector. Bioengineered 3:222-226.
5. Romanutti C, Keller L, Zanetti F A. 2020. Current status of virus-vectored vaccines against pathogens that affect poultry. Vaccine 38:6990-7001.
6. Sadigh Y, Powers C, Spiro S, Pedrera M, Broadbent A, Nair V. 2018. *Gallid herpesvirus* 3 SB-1 strain as a recombinant viral vector for poultry vaccination. npj Vaccines 3:1-7.
7. Calderón K, Rojas-Neyra A, Carbajal-Lévano B, Luján-Valenzuela L, Ticona J, Isasi-Rivas G, Montalvan A, Criollo-Orozco M, Huaccachi-Gonzáles E, TatajeLavanda L, Alvarez K L F, Fernendez-Sánchez M, Fernández-Diaz M, Tang N, Yao Y, Nair V. 2022. A Recombinant Turkey Herpesvirus Expressing the F Protein of Newcastle Disease Virus Genotype XII Generated by NHEJ-CRISPR/Cas9 and Cre-LoxP Systems Confers Protection against Genotype XII Challenge in Chickens. Viruses 2022, Vol 14, Page 793 14:793.

8. Baron M D, Iqbal M, Nair V. 2018. Recent advances in viral vectors in veterinary vaccinology. Current Opinion in Virology 29:1-7.
9. Hein R, Koopman R, Garcia M, Armour N, Dunn J R, Barbosa T, Martinez A. 2021. Review of Poultry Recombinant Vector Vaccines. Avian Diseases 65:438-452.
10. Salsman J, Dellaire G. 2017. Precision genome editing in the CRISPR era. Biochemistry and Cell Biology https://doi.org/10.1139/bcb-2019-0137.
11. Suenaga T, Kohyama M, Hirayasu K, Arase H. 2014. Engineering large viral DNA genomes using the CRISPR-Cas9 system. Microbiology and Immunology https://doi.org/10.1111/1348-0421.12180.
12. Ran F A, Hsu P D, Wright J, Agarwala V, Scott D A, Zhang F. 2013. Genome engineering using the CRISPR-Cas9 system. Nature Protocols 8:2281-2308.
13. Chumbe A, Izquierdo-Lara R, Tataje-Lavanda L, Figueroa A, Segovia K, Gonzalez R, Cribillero G, Montalvan A, Fernández-Diaz M, Icochea E. 2015. Characterization and Sequencing of a Genotype XII Newcastle Disease Virus Isolated from a Peacock (*Pavo cristatus*) in Peru. Genome Announcements 3:e00792-15.

SEQUENCE LISTING (36 sequences)

SEQ ID NO: 1 - DNA, 165994 bp, unidentified
  source 1..165994: mol_type = other DNA; note = Gallid alphaherpesvirus 3 (GaHV-3) cepa SB-1
ataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggctgggccgcagcctcccgccgccacaggtgcactcagcccgcgggctgccgcaccccgcgaactgtcggctacaggcagaatgaacgcgcagcattgcgcggacacagtgggtgaccgaagcacaccaccacagactctgaccctgccatagccccgaccgtgaaatgaggcccggcgaggcctaacagtcaccccgaccgtgatacatgacaccaacgctgcccgttacattaaaaggtcctagccctacatgccgtaaccgccaaagccgctacccttaatatgtcctgaccccgactatggactattaccctaaccctgaaaggccataacagtgaccctaacagtcctgacgccgaccccgagaggccctaaccgccaccgtaaacggccctggcccaagcccttaatgtggccctaacaggcactaaaacgaataagacaggccctaaccccgaccgtgatgacaggccgaacccccgaccctaacagaccctatcgcggggtccaataatccgctttcccaccccgtccttcaacggaagagtgcgtgcttcagacccgcggacccgggcaacttgtacccggccccgagcgtctctgtgcaacgcactacattgaaagtaaacaacaggtaggcggtgtcgactcaggtctgtgcgaacgccaaccgctttcaagaacggaggctacgcgcagtcacgaatgaggaagtggttttgtgaggccgatcccctttcctgtttttttgagactcgcagccgattccgagaggaccgggagcgcacgacgatgggctcccgccttacagttttctccgcgaacaccgtactcctgctgggaaggtaagccgcggtccactgtttacttcccgtgcaagcacttccgcgtacgcgattgtccggcacgtccggacgcgcttaatttccgtgtcctgactgcatccggcgactacagcgccgcatccccccctcaaccccccccccgtagattccatggccgagtccgccacaccggctttttggaatttcgcggggggctggcggagaccgcctctgtcccggcgctcgggaagtgcgtacaggatgtttttctttttccggcagcggtgcagcaatggcggggacgcaggacgcttgggaaccgcggaccgcagcctttgcgtcgccgccgggagacggcggcttcatcgcgcacgcgggcgctcctagccccgacccgggctgaagccgtcggccagtacgaataaaaacgcccatggaatgctgctacgagacgcgtccgtccgtccgtccgtctggctcgcgcgcgagcgcatgcgcgcacatccgccgtttccgtaaacaccggaacgacaccctcgccggccccgaccctcaatccgcggcacgccctgaccctataaccattacacgccccgccctaattccgagagaccttaacccctaacctaaccctgttaccctacccctaacaggccctaaccctgacggggagggggaacgcctccttaacagactaacaataatggggggggggaggagggtcgctcctagccctaacgggcccaaccttcgcgcctaccctacccctgccaggccctaaccctactcgggggggggaggggggatgggaacctaagcgtggcaggtcgaaccgtgtggggggggccctgcccgtaacagaccccagcccctacccttacgggccccaacccttacaagaccctaaccttagtactcggtgggagcctaacccgaatagggcctgacattaataggccctaataacccttacacctgtgaccacgaactctgataggccataaccctgaccttgacaggtcctaaccccgggcccctaagccaaacgccgcccttgagaccctaaccccgaggccttaaccctgacccagagaacctaacactgataggccttcgcgctcttagtctctgatcataatcaccccgaccctaaagacccgatccagaagcctaaccccgaccctaaagacccgatccagaagcctaaccccgaccctgaccctaaccctgcccctaaaggcctaaccccgaccctgcacctgagcttgcccctaaaggcctaaccccgaccccgacactacccctaaaggcctaaccccgacaacgacactacccctacaggcctaaccccgacaacgacactacccctaaaggcctaaccctaaacccgacactacccctaaaggtctaaccccgaactcgacccgacccctaaacgcctaaccacgaccccgagactgcccctaaaggcctaaccctaaaccagacacaacccctaaaggcctaaccccgaacccgacccgacccctaaacgcctaactttggaccccaaccctaaccttaacggcatatccctgtccatgaccctgacacccgaccctggcactaacccttaccccgagcccctgcccctaagggcccaaccatcaccctaaaggcccgaccctgcccctaaagacctaagcatgaccttaaaggcctaaccctgaccatgaccctaagggcccgaccctaaccctaacctagtaccctccttccacaccccccccccgaaaaccgagcatagcccaacaatgaactcggccggtttaaagatttatttcgatgcgatgcgcggtcacgcccaccacaaaaatagaccctgcaatattgatgccggaaccagcccatcgcagagcgggcgaccgctacacgggacgcgtattcgtcgggaccgcctttctccggcaggtagcctacacgtacctcactatggccataaagatgcagccatagagaggtacgtgaagaagacccgtcggaatcagaagcaacatttcaggacgtacgactcgagccggacatgataccagacaccggagtccacagcgaccgcgatttcctctgcgcctaccctcggccgacgaacaacgccgagggtaggcgtcgagaaaatcgcgaccgagggtgcgccctcgttccacgcgatcccgcagaacgcttcgcgcccagtctccgtccatcgacgtggtgcttgatgacaggatccacctctaacaccacgcgatgcgctccgcagcgccttcgtcccggagtagagcgccatctccttcctccagcacggtgctcgacgcggcaatacaaaagtctcacgcctcgaacaccggacgaaggagggaactgcgcgcgtctggactttaccggggcggcttcgtcccgcggcgttccggatgacgtttcgagggcccactccatccttcggtgcggtgcccgagaagggatgacgacctctcacacacagcacaaaggacggcgctgggctccgtccgatgctctcgatctcaggcagcacggcaccgatccggagagcgcgtcgcacgtcgcgtcctacccccggagtagtgcatgacggttactccccggcaagcactcgtccgaaggaggacacgccacgcgacccgattcccagccgcttcgcgcccggctacttcttcgcctgcagtccgccggcagggctcgagcaaacaaactcccatctttccctgacggcatctaaccgttaaaatacgacgtcaggcaccgtaagggaaaaaatggaagcagttcggagtacagacgcctaaccacgggccctctctcgcccctccgcgtccgatatgcagatcggtgagagtactgatcgtctcatatccgcaacgaagacttcgggatcgatagacgttatccttcccgcccccccccccccacataggaacctctgttccatcgccatctgttacaaaaaagggcgagcctatccactggcaacgagcgagaacacagctaggcctcccaggtcgtaacaagccacttacgtcgtcgcgggggaaggtcggtccatttcgctcctattccgcaccttcgtttggaacagaagcattacacacaccgccatttccccgcgggcagaattctagtctttttgtggttatgctcccacctacccgcacagacacgtactcacctctcacgatccagcatatcgccgtaagatttacagacattcctccctccccacccaaccgaacactgcacagcggcagcctaaaagtcgctctgcggtcgcatatcccccccaccccccttcgatggtccggtgtacggagacctctcacacaacacaggacaccgtaccacggaccatccgaacggcgggcgaacagtcacgcaggacgtggacacgagtcctgcgctcgcacaggcagctgggcggcggtgctgtcttcctccgacggacagcctacaagcaagccactaggactaccgatacgaccagagtgacgtgcgtgtaagacggcccaggacgaagtcccgcgccccgccgaaaataacagcaccgacctgaaagagaccacgtcttacccaacagccgacccccgaacgatgcacgctcccaagagtcggccgtaggagagcacgcgcccccccatactcggcgcgcgtacccgcggccatccctgcagcgcggcccggcctcgttgcgattcagtgaacgtaccgcgcgccatctccgtccatcggcgtggtgctcgatcccgtcattcggtgatctcaagcaccccgcgaaggaggaagcggagcgtgtaacgatttccgcggcgcgcgacgacgccgcgccgtcccgtccgacgtttggaacgccgcctcggtccttgcgcgcagtacttgagacgatacgtgttaaaatctcaggcaccacgctaaggacggagcagagctcggttcgcttcgctcgcgcgccgacgcatctctgcttcgcagaacctgttttgaaaagaccgcagcgaccaccgcgtgctaccctcggaggggggcatgaggacggcgcccgatactcccgtgcacaccgccgaggggggacacggcgcgcgcgccgatgctcagccggttcttcgcccagagccctcccaaccttgtcccacacgacggggagcggcacggggaatcaattcgtctttctctccgcaggcattgcacaacggcaatgacacgtgcaatgccagcctgagagaaaacatacgaacagtcccgagttccgagtagtaactctcgctttcgcgcccttccccgactcgttccgagcatatcaggcgatacgaggcatttcgcgcgcgtcgccctgtccgtcccggttgtcctagaacgtgacacctctaggggacccgggaaggactggacgacgcgccgtcgtgcggtccgaccgcaatacggcgtcgttaccccttcctcacaacacctgatctcgtggcctaaatacccgctcatcgccccgcatccgacgcctctacctcccctttgtccccaaccgagaaacctatccggggcccgctaaggtcgaaccgccgagactccgtcgtccggctattacccgccataacaagtcgctagtcgaaggatggaatcgcagcggtccgagcggctctcctctgatatcccggcacggcctattgggattaaggtccgggcctattcagattacggttagagtcctcgagaaacatttcagtctctctggcatctgacaacggctacgcgccactcagatgccaaaacagactggatgcgtttccaaaggccatcgtgtctaacaaaggccagtccctgtaactaggccaaacatctcatcaccgtccaagtcacaggtacttcaggtttacggtcgtctgctatctacaacgaagaattcagagccgatctcgccagggccccttctcccccctcccttcttcccccctcccttctccccccctcccttctcccccctcccttcttcccccctcccttcttcccccctcccttcttcccccctcccttcttcccccctcccttcttcccccctcccttcttcccccctcccttcttcccccctcccttcttcccccctcccttcttcctcccttccccccccctcccctcttcctcccttccccctcccttccccccctcccttccccccctcccttccccccctcccttccccccctcccttccccccctcccttccccccttcccccttcccctcttctcccccccccctccccactccctcccttcttcccccttctcccacctccgttcagccttccccctcccccctcccttctcccccctccgttcagccttccccctcccccctcccttctcccccctccgttcagacttcctcctccccaatcgccccccttcgcaacttgcgaaatctagtctaacacgggtttacttacgcggtttacattcacacagcgggtgcatgttttccgctgacatttcccaagccggccacaagaaacgaagcaaaaaaaaaaaagataggggtattaatgcgcgccacccgtcgctacgcagcccgactccaaatttcgaataatgcccttctaggcattggaccgccgccccactccccgcgcaatatctaggcttaatcgccaagattgaccacgtatcccttatcgcgccggccgttcaggccctccccccccccccacgcctctcgactcttttttttttccatgggccgtccagactgagacgacacgtagattcgcggtcgtcccagaataaaggatgaccccgcgatgcccattcccactcgcccgacgtctccctccgattcaaaagtactgcggcacgacctgcgatggaagggaaaaacacaccaaacggccttaagttttccggtttgcctttcccttccatcgcaaatagcccgcaaaagaaggatcgcatttccggccccgtccggccatcgcgactcatccaccggccaaacggggatatcggaccgcgagactttaacggctatgtatttccccacccgctcttctcagaggaatccccgatgcaatctagaagcttatcgttcagagcgtttcgggcacggaacttcctgagaatatagatcatctctcagggtgcaccgtaccacacaacgtttctgtgggaaaacggaaggccagtcactttcacgtagacccctcaggatacccataacagaaaaactcagccccccctcccctcacgaccattttcctacgtggaatgcactacaagtacctgacattttgcaaacagggcgccgagacgtccgatggggttccagcttccgtggcggacgaaccaacaccagtgtgggcgttcgcatctccccccccctcccccccccccatacatgaaagacctacgattactgcataggaccccgctcctgggacaaatactccggaaacctccagggatcggaaatttatttagaaggggggtggggtacagggcatgcttgcttaggatctgctcgaaacttgactataaaaggcaatctgactagaatcgccaaaggcgataggtctcagaagaaaagtaggacgcgcgggggagggataattgtttacgcgggggggaagataaatggcccacggcggaaacgagaaagcgcgggggggggttaggccttggaagggggaaagacgcattcgcgcatgtcagaattaagatggcttccctataagacgaacgcacggtttaacagaaaagcggacatcacgccggggtcgaacgcgggaaaataaaaccgttgcgggggggggggggagtccgaaccgtgcggcgggaaggctccgagtccgaccggaaacggaaaaaggcggcacggcacggggcgctcaacgcacaggggataggaagaatttcccctcggcccgcggattcggatcgcgctcgcgatccaccttttctccgccgactcgccgaccgcccggaacgccggtacttacgcgctggagaagccccgtattactcttcttcccggattcggccccggcgcttctgcgtctgcgcggcggacatacgcagttgcgcttccgtcgacgtattcaatgtaaacaaggaagtcggccctgcgacttccgcgatcgcgatcgcgaaccggtaaacaacgcagggggagcgcggagcgcgggcgcgggcagggagttaacctcgcgatccgaccgcgcattcggatgtgcgggtcgggggcgtagagataacgcggcgtttccgctccgggccggagaggctggcgggcgggtctctccgtacattctttttttttgcaaacgcgccgctgcgcgcctaaacgccgcagcggcgcgaaacgcccgcgctctctaagcgtccgaaggccgtacggacaccggtgcgtccgggcgctcggccgggcgaacggcggagcttttctttctcttttcagtctcggagaaaacggcccggtgcacacctcctctcgggagcgtcgcaggaaagtaagttcgtgtcactcaccacccccccccccccgccatcgacacggagtctgagcatgagggctttaataaaccgatttgaacgtgctacgacgagagtccgtgcaagtgttcgcgctcgcgcctatacgtactacgacagccgctctgtagccgcggtgtgtgtgggggtgtgtgggggtgtgtgtgggggtgtgtgtgggtgtgcgcgcggccgggacgggattcctgattccgtagcacttcatctcgaatgtggaattcggttccgacgggggccgttaacacatatacgcgacactggtcggaactcgcgacttccacggtcgccgcgtaagtcagtggtgcttatacgtgggaacgaagcgaggctaagtagcaggtcgcgaacaaggaggtggaccgcggggctgtttatatcgcatctgcgtctcccgcggggccggtgagctaacggctcctccccgtcgcgaaactgtatcccccgcacaaacacctggacgatccgcgagcgacttatgatgcgcgtgcccctcccccaactaacccttcgcgcgcaccgcgggcctcggcgcggtacgttctccacaacactaatcgcacgcattcccggtcgcccgtcgccccccccctcgcacatcccgcctcgggggagaggagaggacaaagtacgttccccgacttacgcgacggactcccccgcccgcgccatcgccagacaccgaaacgggaccgaagcgagaaagactttttaataaacacgttcatacgcactacgacgagaccgctcgcacgcggtctcgtacacgcacgtacaccttaacgatcgacgcactgtacgcgagggctaagagcgggcgagcgatccaccccgtttcgcaagaaacgacgcgtcccgggcgcggctccgctaagcattcgtttacacggcagtttcggcgtctccctcctccggtcgtccgtaggagccctctgcgtttccccgcacggccctcgaaaccaaactccacagactcttccagacgtttgcgacgctaggctggcccggggcgcggacgcggtctgagggcttgagccggtggctgcagctcgtgagagcgtgttcgaactctgaaacgtaaaacggtccggctcgattccggataacgcaaacgtcttttcccctcccccccgatccggcaggcgagaccttcccactcaacctcggtcccgcacgggcttgggggggggggggggagggaaatagccggccgaaccctactcgggcccggacccaaacgacatcgctccaaaagagagcgttccgtttgacggagcccgcggtgcgtacctgcacgggattccggatcccgatcccatagcgaccaatctcgaatactgaactccgttgttccgtcggaggccgttaacacatataggggcaattggtctgggctcacgattttcattgtcgccgcaaaagtgagtgtgcttgtgtgtgcaacaaagcgagaccctctaccctgttcgtgaggagagggtcgcggggttgcatatatgtggcatatgcgttgatcacgggaccggtgagctgacaactcctccccgtcagggaactctattccccgcattaccacatggacgggccgcggcgtcgcggcgtttcccacacccctccaccgaccatgccccacccccgctctcgttcgagaggccgtcccctcccccatttcgttccgcctcgtccagagccagcgcgggacttcactttttccccatccctctactcctatctcgttgcccagcccacgatcgctatgtacgcgttctctccgaggccggctcgcgccgagccggccagacaaagtcacttcggaactgacgccgaagtgagtgctgaacggttgagggggcggcgtatcgcggataagctattctcctcggagtctttttgcggcaggccgcaagcttcctcgtacccccctttcggggttcgctagaactcgatcgaaacccgagacgagttactactgagccgatccctacagctcgggaccgctcccgaacagaacgcggcctcatcgggttctttcgtagagcgccgcaagggcagaaacggaccgacgcgcgtccgagactcatcccgagctcacgccgaacggctttattgctccgcttccgaacgagagagcggtcctatctcgaccggcccgttttcaatcgattcccgaggttccgacctcgccgcgggtgcggggccggggggaaagtcggggggcgacccgcgaccgtgttccgcgagcggcgttcggccgcgtcgccgacgcggggtcggatctcgttctcgtgcgagggatcgggacgatccgcggacgagaacgatggggcgtcctccctcgacgtccgacggttccggacgccgcgagggtcgcggcccgaaggcggagatgccgagctcggccagttcgatgccctcggtacccatcccccttccacccgtcggcgacccccgcgaacgcgagccgtagacgacgttctcgggacggcgcgcgatcgcttcccggccgcctgcgatcccaacgggacgggttcgttcgccgcgcggttcgcccggcggtaaaagaacgaccagaaaatccgatccgcgacggcgggcgctttattaccgcggtcccgcgctttcggacggcgggccggccagcggaacgacggtccccgccggacctccgctcgcgtatttgtaggccggaggtccccgaatccgcccccgtgggaggggggcggcgtttctagcccccggcgcgggccgcggccggacacgaacacgtggcataggatcccgcttcccgattggcccggacgggcgttcgcaccttgcgccaataatatattatatatataatcttatattggttcgcggtgcgaacgctgacgcgttcgccccgctcgtttgcattgcatcacgtgatcgttacgccctcacgaccggcccggtcataagaagcggaggcgccggatctccgcttagagcgccggtccggcgcttcccgcgaacggacgcaaggtggcggcagaggataagcgatcgccgaacgagagccccgtcgggagcgatcccggatcggacgccgcggcgaacgcgtaggtttcggccgtctcccccttcccttcccccacacatcctcccgccccccacaacctcctccccggcggcctcggacggcgcctcccccgctcttcccgaactgcaggccggccggctaccctccctcccccctctcctccttccccccctcccccttcttctcccgtccgaccggcccggcggaacgcgatgcggcgggggaaaaggcgccgatccgacggacgcgatcgcgacccgaccgctgatccgcgcgcccctccggacgccgagagggatgcggagcgcgagagcggagccggggacggagggggcgacccggacgccggagagaacgacgccggagggcgcggaccgggcgcggacccgggcgacgacccgggcgacgacccgggcgacgacccgggcgacgacccgggcgcggacgcgggcgcggacgcggacgaggcgcacgcgcgcctgctccggcgcgccgagcgcgaaaacaagaaactccgaaggggatgtaatttagtgtttactataagcaacaaaaccctagtagtcggaacatgttttatgcttgcggcaggtgtactagtcggtgcaagtggtgctgaccacgagactgcatgcaacaaaactaatttgctgttggtatttgttactgccctcttgacacgatttatttgaaacggtaacgaatgctcgtgtactttataattgcatgcccgattacaatctgttctgtaagaatagttatacgtagcgtgttttacatagtcttcgatgtatagaagagacgcagtcaacttgccggtgccgtgaaattgtctccacactatgatgtttttactgttacaaggtaattaaagaccttcgagtttttcactccacttgtgtgacgctccttcgattatgagagtacaatgtcgtctaagggggatgtggatcaccacgcgggttatggggtggcactcgcaattattgctctattgctcgtacatgctactgcactgattatggtgagtgtctttttacctctgtcccatcagtaattgctaaacaatgattgttttaatgccaaaaatctttttttagatcttttctgatgtcaaattcagaccagtttcacaggatcttagtacgcagtacccatctcataagcattatgatgatgcgtactcgccacatatgtctggggtagaccacggccattcggatgtatggactaacactgtaaatgacccatccggcggaataaactcaaatttgcctggtgcgaagagcgtggagaagatctatcctagcgtagaaccaagtacgtcgcatgacaaagtgtcgtatggaaatgcatggggaggggacataaacaccggcagtgtttcaccttctgatgacaaagcattgcccgccactgtcgaaccatcgacggacatcgtttccatcgcgatcacggggagcagtttaaacggagaaagtagttggcggatttctaaggatggcccgcgtcgggtttatacaccacaccagactaaaagaagtcctcctcagatcgatggcacgcgtttatctactagaacggcatacttgagtgtgtgggatgaacaggaggggatttttaaaacgttcccggccaatgctgctgcattcaatttattggacgctaatcagttagagaaagcgcgccgtgaagtttttttcgttgtgtcggtgtggcatggaaatacgaacgaaacccgtatatttttatccgccacgaggctactgacgcgaatgatgtccacatcgctcgtcgtttatctttcctgggactctcgaggggccctggggacgacaactgatgcggcttttctggcacggagcgtaaatatatcccagttcctgaccgctgtaccaccacattcgcaagttcgttgtatgggccattcattaggaatgtatacttgcggttccatctgtagacaatataatagtgtaggtacgaccagatgcaaaagcattttaagtattgatccttacggcgcctcatcacccgagtctcatgtatcctcggcagacagctcaaatacaatacgctttgatgccgactatgttgcgattttcgcaacaagtaagtggcacttgaacacgtccgattcaaacgcagacgaatatataatagtagatggcttgaatgcaaatgctgtgtgtgtcgatccctacgagtggagtgtcttattgtgtgttagcaatcgccaacgaaatgccgtttgtgagcgattcggtgctaacaacgtaacgactaccggcgaccctgcggaagacggttcggaaacatgcatgcgaatactccctatactatcggtgctgcagtcgctcgataagaattctgcgtatccgctgttacgtatggatccgccgggagcttctgcagcggtaccatccttaccgtccacatggaatatctacgtgatgggaaaggattacagatattctacttatggaaaaaatgagagcctgtggtattctagcgccgtgcatatgggaggaccgggattctttcctgcgtcggtatttactgtgtttcttccctcgggtatacccgctgtggtatccaatgtcgtgcaacacagtagcatcagttacggagatgtagcggttcattccgctttcttaactgataggtccctctactacccccgagtgatggtccaaacatccgggcctattttatctgcctattcttggagagcgcgactgcataatgacagcctctatttattaccacttccagaacaggagataatgcaatacaaatgcgcagttgcacagggaagctatgcatgtagtcccacaggcccgatcttgacaactgttatgtggcgttcactgttattcgcgggcagatcttcgccggtgcccccaaacggtagttgtttgacttatatccccgctaacacaatcatccggagccggtcccccattgaaataggccctcgaagtattataactgcatcgtttcagctaagcagacaattaatggctatgacgctcgaaaatcatttcacgtccacgaaccggactctattgacatttcatgatgtgtgccacgacactgctatggagtcggatatatacttcgagtataactggttaggcgcatcgatgaacattaccatactgaaccccggcctctatacgtttagatggtttttcccatttgaggttttcgtaatgccggtggtagttacgcctcccaagtccagagcggataccgtcacgatcgctcccgtaggactataaccctgttggacaaataaagtatacagactgttcaaactgtgtagtgagtccatcttagtcgtactggatgcaaacgagcccaataaagtgtaacagttgggaaaactttaactgtcgtgggataacccttataatgttatagtgcagtgactgacttgtaagcaaacattgactggaagttagcttatactgtacttcgtcgagactgccgttgccgactgtacgatggagcggcctctcgatcgtgactatcaaagtgcgataacgtgcttgacgtgcgagagagtacttttttgtcgcctctgacatgggcaggttcgtggcgataactccaactacatcaatgccaagaggtttaagcgttaggtcgccggtttaaatactcattcggaagccgtgggtggcgcctcgcgtaccccagaccgttgtgttataaaacccagactcgtcgccacacatgtaggcaaaaaaatgactagcgaaagagctcttgcgctagcacccggtcgggcggccacggcagatttctacgaagtggatccggtatatcggcgagacttcgcacgccggcttttacaacgtaagttccagcttgtcgtgttgtagaggtatttactactctgatcttcacctaattagcaccatgccgtttgtatttaggtttattccccaagacgcttgccgccgtcagggaatcggagggaggccgaaacacgcgcccgcccaaaacagatctgtgtacgcttttgcgcataatcgcgcatcatgagaccccgcacattttcaccccaggtcccagactcccgaaatcctcagcaattgtcgacgggctatgggtagcgtgtcgaggacttgcggcagagtgcatgttcgatggccgggcgacaatagagttagcagaacgcctcgcaacttcatggttgacggccataagattaattctagtttggcatcccgtgtatgccctcggccagcaacacgaaccactcgagcggatatgtcgccaaggtcgagaatatattgctatgctctcgggaacgattcaaacatcgtatgcgacatggccgttttggcaaatgatgcaacgatgcttagattggtgctgctcatttcacatccccgatgaccgttcttgtgagcacggatctccacgtctggggatccaactagagggcgaaaaccagatattcgcgccaagtttggggctctactccgctgtaatggcatggaccccaattccatgtcacgtacaggttcctgtatttccgagacctggcgaatcggacgatgtctcgaccccgcctagtggggcacagataggacgggtgcgacctcacagtcttcaaaggctggcactaaaacacagacctattgatgccgatgtacatagacccatgccgttaggccggccactcccttcaatgcatatggacgatccagacgatccgcaacctggaccctccggacaaggccgggcgcccagaactccaactctggaaggagtccgggtcgcagaacaaccggtaagtcttcgccgcgcaagaacaccaccgccgccgctcaatgtcgacgaagacgacaacgatcttcctcccggccaacccccccgccctcatcttcgaactcccccatcatcaccatcgtcctccgagactgaaatcgatgaggaacttaacgcgcaacccgatccttggggtacaaaccgtagctctacccctacagataactcctctgccagtgaggatgaagccagagggagcgggttgccccgaccattgcgcagcgcgactactgaaccgcgcgtaacgcgtagaagccgccgtgaggctcgcagccggagccgaagtcggtctggagaccggaggtggggaccgtcccgattaaggtcaatgcctggacgcaggagagcttctcgacaagatacagtacttgtagacagttctgaagaggaaccgtagccgtttgtagtcagggttctagttaagtaggcgccgcgcgatttacgaattagtacatttgggccctgccgcgcagcgagcgtctcacgactgcgatagtcatgcacgtttcgctggtatgggtgctgtgtttgcttttcggaactagtgggggtgttttaaagtggtctgacgttgacttgtcgcggggattcatttcggtcccaaatgtaagttcgcttatgcttttagactgcgctccaaattcgatactctcaactgccagattcgccgatctgacaacagatgatgtccctaccggtatatttattaagatcaattgcagcgttccggaattcattttatggtatgggtctaaaagcgtggcggcgcggctcaacccaattattgcaagcgctttaatgatggacgatgttttaaagagcggattggacgattccgtgaaggcggaacttcgcgtgtttttaaaaagaatatccgaacggctaccttggagctctctccggaaaagacacggttgtctgaacctggacgcaccttatgacttctcctgttatggctcggcacggctcgacagatttgaacgagacatcgaggacgatggccgcggaatgtcatgccgagctaaatcaacccgagctaaagcggcccgcaccaacgccatcgagggatagttcggccgcgattaaaaagcgtcgccggccgatcggacctccgcccggtttcgcgccactgggcgataatgcgccatccccacagggtgaaactgacgcgtacggacatcaactgtcgatgaccgaaaacgtccgcgctgaattgtggcctgttatagccgagtcttacaacatagactggagttggaaagattggctgctccccgaattatgctgtcctaacggctccaagttgttggcggaatacgaacgccgtgctgcggtagaagacgtctttcctccgcgagcagatattttcgcgtggactaagtactgcgctccgcccgacgtcaaagttgtgatcgtcgggcaagacccgtacgttcatccgggacaagctcacggcttggcatttagcgtcaagcgcggcattacaattcctcctagtctgcagaatatattttcggcagtcaaggcgtgctatccctcgatcgaactcggagcccacggatgtctagaagactgggctaaacgcggagtcctgttactaaattccgttttgacagtaaagaagggggagcccggatctcatcactctctaggatggcaaactctggtgcgaaacgtgcttcgaagactgtcgttgtcgactcgaggcatagtcttcatgttatggggagcgcgggcacagactatatattttcaaacggatcgcgacgatcgacatttggtgctgaaatacagtcacccgtctcctttatcccggagaccgtttgcgtcctgcacgcactttaaagacgccaacgagttcctctgtaaaagcggtaaagggggcatagactggagcattggcgcgtaagtgacggaagggttaatcatcacatgcgtacaaaagtcgcagcgctctaggacttgtcgctttctgcgcgcgcaatgaacgataccgcaccttctgttttggcagtattatccaactggggttggaagagcacacccttgggcaccgtaggccccgtcccgattcgcgacgagactgagtgcgcgcgcgaagaccttccggcacatgattgcgaccactggtgtaaaaccgccaatgcagaaaacggacctatggcaccctccccggggaatcgagattttgcgggaaaccaagaatacacacatttcgacactctgtttatggtctcgtctctcgacgaattgggaagacgtcaactgacagatactatacggagagatctaaggcattctctggccaagtttacaatagcttgtactaaaacctcctcgttttcttcctcgcacgccacgaaaaaggttcgcgcgaaaatgtttcaaagagggcgtcagagcaacaagagcttgcagatgtttattttatgccgcagggcacacgctaaacatatccgggcccaactgcaagcggtaattcaagctcgaaaaccccgcaagtattacacccgcgccgtggacggaactacgcatccggtggtgcccgtctttgtatacgagtttgccgccatagacgttgtcagtttgcatcgagacaacgtgatagaggtagacactcccggctcgtgagcttctcgccgctcatcatgttcgtcgtttcggcagctttagcatccgcatcagactacgccgcgtttttgcgggacaacaagcaagctgctcgcaagctgcagtttccgttgtccccgatgccgagccaacggatcccgcatctgtctaaggatggcaggactgcagtcgcccgggaaacggggtcgagcgaggttatgtcagcgagcggacagaacgcgtcgacccgaccggtcgacgctcgtttcgccaacctagacaccgagaaatgacaagaagcatctaaaacgcgcttgattgtcgagtggctgaataaaatctttattgatcgactcgctttcctatttctgatttaataaccatagatggggcggggaatctataaaataggcaaggtccgcgcggattcgagcacatcgaccgcgtccgcgacacagcatgcaagtggcgacgaacggtcctcaggcatgcacgactggtctatctgtatatctgcctcgcggatcgcttccgtgagaaggtcttcctcgtacccggttgagaaagcgtccactttcgagggtccgtacccgtgcacagcgccaatttcgtgcgcttcgatgcacttactaatctcgggcgcgttttcgggcagagatcttatcggatcgcagctctgtcgatgcgcatctttattagggtctgcgatcgcttggcaatacaatcgcgcgctggattcgtgaccgacccgcattgcattggctgtttgtgtcaaagagccgggcttaccgtagatggtgatcgttatgtacagtgacgttcccatccacataacggttaaaattcctccggaactgctgtataagtaggcatccggccccgtcacggtacacgtagcaaatggtatgacgcacagggattcgggcagaaaggagagcggcgcggcatggtattcggcgccgcactcgccgacgcgtagaagataagagcaaatgtccgcgccgctgtcgacaatgatcagggtacctaccggtcctcgctgtatgataaagttcgacgatgggatatgatcgcatctggtcatcttaccaacggcaatcgagcgcgtaccgcctgcacatgagcaaaccatctgctcataaggaggcattgtccacgcgggctgagcagtgacgttctcaagcgtatacgcgatgaacgtggaccccatcatatccacgtctcatgtgacggccctatgcttcatggccctagttagtatacaatgtggactttcggatcccggagggcggctaataagtgcgcgctgatattgttatcatccctagtatgcgtttcccgaagtgggttaatgttcatcctcagaaacttagaggaggtcactcgagacatggccacgtagacgctgctgagtttgatgcccgattgggcaaaacatatagcaaccctctcaaggctaagcccttgcgatctggcgatagtcatcgccagtttggagcttattccgtagtcggcggttacggccatccggagttcctgatcgtctaccgtttcgacaaaatcattgacgttggtgttaattgctgccatgaaaccgtgttgatctttcaaaaccagggtcggcatgtgaagttccccgagcgcttccgcgacctggggatgtatcttacgtctaataggctcgtctgcaaatgtgttaattctagcgtatgtgtaacccatgagagtgtagctgtccgtctgcaaagcgagcgatagcattcctccgcgcatgctatttataaatatttcgcaccctttaaagctcacgttgtcgacataactatcgaatctggacgctgcaaacttttgcccgaatagctccgtcaggatagaatacctgcccataaacatgctcttaagcatgctgaactgggtatatatctccgcagaagtttctgcgcgtccaaattcgtaattgcaataaagcatgtctatcatctggtcgtcgaaatccataaatagggcatcgtctgtatcctccacatgactgatttggtcattagctatacaatctaattccttctcactgccatagcggtgtcctggaatcgcgaacgactccctctgctccgctctatccggaggttgccgtcccggatagagcagcgcagaggtaagcatcgccaatctatcgtacgcgcttttaacagaattgtctggaagaccctgccgttgcagatagttgtagaactgtatcatgccgttgaaaagcagttgagataagaaacggtacacgtattctacagacccatctccgtgcgtctttatgaaggaatcgtctttcaatacggatagaaatgtctcgaacgtcccgcaaaagccgaaaacccacttccgaagtcgggtagtaacagccacttggctgtttaagacataggcaatatctacacacgataccgcgagcccctgttggctgcgaatttcacatttggcctgtgtggcatcttggtcgcgactttgcgaccagttgctcaagcgtcccgcattggcagcaagccatttttccaacgtaacgtgcggttggttggcagcagtacgatatcgttcgaaactatccaaactgacgaaggtataagccggcagggtaaacactacaaatttcgtatttccggacgttttcaggtagtcgtgtaatctgctcatgtacgcgctgacttctttatgggacgaatacagacgcgtccatcccggaaggttcgcgggattgttgatgtatgcttctgggacgacgaaactatctacgatccgagcgtgctcctcggttatgggaagaccatactctaaggtcttgaggaggtccccgaactcgggttcggtgcaccgtttgttattaatgaatatcgcccagttcttggacagttctaagtacgagcgcaacgtctggttgcatataatatacgtaagaatattttcgctcgtacgcacattacacttcagcttgctatgctcaaatgtggactccaaagaattcgtttgcgtgggcgacccgacgcatatcaataccggcctccttcttctacagtactgcggcgtgcggtaaacggcgtttgtgagccaccaactgtatacgatagccgtaagcaaatactttcccagaagtccagcctcgtctatgacgattatgttactgcgagtgaacgagggcatcgaaccatgtatgccgaagattgtccacgccatactaccgcgaggcttgcttagcagatcctctaacgcgcgaatcatttcaaaccgccctggcccgacctcgttagacaccgccttcaaggcgcattttgtaatgtcggataaaacgtcccaataatacactatatcctttttctgcaattctttcatcgtcggtgggctggtcggacatacgtactgatattttcccaaattcgcttgaatgtgattacctttaaacccgaattcctgaaatatcgtgtttatgtgctgcgatgtgtatgaattgctaagcttgcaataaatattctgcgctgcgacctttgtcgtgccggtgataatacagtccaagatttcggatagcatctgtatgcacgtgctttttcctgagcccgcatttccgcttattaagtaaacggcgaaaggtagctcgcggagttctagatccaacgggctttctagttttgacgcgttcataaaatacgatagcggggggactatatcatcgctcaccgatgcgtccgccaggctccttacacgcgcaatgatagtctgtatcccgtgcatcgcagtgaaatttagatacgttgcctcactgaagaaatcgttctcccgcgacatcgtcggtcttggggaagacgggagtgacgaatctacgtatcttttagggtcggggctggcgtgttgtttatttccgatggagagctcagacgttcgggccgcacgcagtcccgccctaaaacaaattcgacggccgcagttgcaatctgtcacgcgccaatggaaactttcaagcgacggcgattcgcaacagtccctggaacaggactggataataattcaccctactcgccaaacacgtatgttcaaagaggtcctcaccgggcaattgggatatacagatggacagggcatatataactcggtacgatctacagaagccgcgattcggcagattcaaagtaccattctcaccctttctttagatgcggtcagatatgacgacttgaaagaggattggtcgaagcatatggataggcgtgggatgtcggccaaggaaatcgcaaaaaagtatggcgttcatagtgaagccgaagctgttagaatggcaaagggggtgttttcaacttggcgtaaaactcttcaaatgaccttaatagaattggttcggcacgcaacagattgcttcgccgcggccgagaaaaccacgtcctgcttctctaaatacatagactggatctgctgtttaggtatcgttccggtcgtcagaagcgagcgctctatgcaggcgtcgcggccggatagcaactgcagagatcgcgctaccattcgcccgaattgggtattcagcgatgccaccgctaagctactagttgcggatagcgttatggcccgcgcacaacaaatcgcggattacttaactgcatccatgcaagcactgactgtgatagaatacgatagggcccagatagaatataatttcttaaaacgtgaacttcgcgttaaggacgtgttgagcggcgaacgtggcgagtgtatcgttatttggagaccggtaatgaacgacggaggggtaatttttgattcgcccatgcagagaatctacaaggagatgattgaatgtcacgatttgcggatgcatgcggcgctgtgtcggctagtaaacacggcccctataaaggtcctcatcgggaaacgcgatgaggatagtaaaagcatggccggggctcaaagagcaatcgataaagttctgggagaccaaactgaaacggcggcgagctctgccgcctctaggttggtcaagcttataattggcctcaaaggtatgcgtcatgtcggcgatatcacagatagagtgcgggattacttggaggaaaccggcggacatttattggatgcctcgcccgtggatacatctcagcctggcttcgggcgcgctaatcgaccacagagttctacgatatccgatggaacttgctccaataccgctagactacgtgatgcgttccacgcgtccgtcgtgacgagtataaacgaaatgttagagggctatataaataaacttttccataccgtggaagggttaaaggcggccaataaagacttatctgcaaaattaagctctaaagaaatagagctcgacagaatacgcacggaagccctgatctcagaacgggcgcgagctgacgcctcgtgcgatcctcactgcaatccaaccatggaaactttggtgcgcgagctaaaacatgacgtaattgacgtaaccaatgcaatggaggatgagtcctatatcgcgaatagcttccagtctcaatacataccatcatacgatggcgatttgaaacggctctctaacatttgggaacaggaaatgttgaggtgctttaagatgactcgtatcaccagtaatcaaggtcgagaggtttcgatctcctactcaaatagcgctataactttattactcgccccctatttcttctccgtgttgcagatctatgatattggtgcgatggtcacgagccaagacgtttacaagtcggaggaggagttatgtaattccgtgcttgaaaaaacccgactttgtacatatctggatgatttggctctcgtctttgaggccgatgtgaaaagagctgtcgcgaagtattcgctccgtgcgggtaacgccgaaatagacttagcgcccgaggagttttcgtacggctctcatggaagcaaatgcgagacacggttttcatccgctagacacgagcgacacgttggacgctctagttttaagcacgctaaatggagaagtcggccaaaacgagaccgtagaagaactaatttggcaaccgacggcgcggatgatgatggagatccgagagattcaaggcggtcctactcaattcacgggcgtctccgtgagtaaacttcgcgtggcaagatgtgatacgcgctttcatctgactttaaccggagccgacttggatgatgaaatggcaagtgacgtataccacagtcagtgcatagttaattcggcgttcaaaggtttcgtctttatggttctcacggttacggaagatatagtgcggacgataggggttccaccccctctgctaaaatacaggctcgtgttctataacccatctgaacatttggacttcgcattatgtttgctcgtagcctatttggagaatctccatgcaagcgcctgcgacgtaacttttttcgtacaggttcaatcttttctgagatacgcatggacacgggtgacgccaatgaccaaaatgcgcagatttttatgcgccacgaacgtttggttactaaacactttgatgtcgatggggtcctgtagcccattcgacggagatcgagtactcccccattatgcgatatacagacatttgtgttctaccagtggcgtctgcgacgtgttactaaccttgtttgaacccgatacacggcaggtacgtgaccgcacgcacggcaagggacttgtcatgctcaacagaggaattatgaataaggcttttcggcagacatggattagtgatacggtctacgattggtggaccggcgaacgcgagaagttgatcggagaagaatctctgttcaacacgtataatatatgaataaagtatgacaggcactgctataaatagaccgtggtttcttagcgttttcatttatttattgcggacgaacagaaacctgtacggctctacgtcgaatgtgaatttgctgagatcgacgttaggccatttcgatgttagagcaccgatcagtaatctcgaaaaaatggacattattggtttcatatgatcgatgcacgcgatggcagggagaattacttgtcccccttcgaaaagtgaacacgtgagaggtgctatgctgccgtccacagtcacggtgtggacggcgtcgttactgaaggcgctcgtatcgaatctagctgccgcccgtagtcccaaagccgtgatatagtgagtgtggtcgcgcgattctgcgggacagctccaaaagcaggcgtctccgcgggcttcgaaagccgcggtcacgagctcttcgaacactgcacgcgatcgttcttggattgtccgtagggactcgtcggaatcgttgcatgcggaaatttcttctaaaagggcagacaaggctttcttaacttggcccgcaaacgcaggtcgggccggaaaccccacgaaatctgtttcccgcttagtttcgttccacagccagtaacaattggcattccacgatactgcatgagtgtataccccttccattcgaaactctaatctgatatcttcgggaaaccgtagcccgactgacgtggctaatttgttagcgctcttaccgcaagcgactcgtagtgtttctaaagcggtttctgttcctttagaggaatgcagaacgttgttggccccgtccgtgaatgtcccccacagtccatctttgacgtaggtacacggggcgaatccgagagccgacgcggtagcttctacctcgagactaatatgattcccgatacagataatagctctataaacatcttcacgcactcttttcaataggcctccgaactctatgatgggctgcttcaaccagtttttctcgcgctgcagtcgagcttttaccgcggcgcgcaaccgggaatgatcgggaaacagtcctagatatagagtcgcaaaaaaggcgctaaaatcaaactttgcgatatacgcttgctctatgaaagtcggttcccggaaaatacaagttatccgcccagccgtccagtcgtcggctacctgacgccgcgtactgcttgtgcgcccttttaaattttcgagtacgtctataccaggggtcggatgggtttccggatgccaaggagcaagcaggtggaaggttctcggtccggccagtggccacaggccatcggtctccgaatagctgccgacggcctttctgatggccgagggggccgccgtagatgttttcaagagcggccaaaggggaaatccgatagtgcaggcatagtcaacgtcctcgccgcgcggactggtttcggggccaatatatacaaatataggggccagccttttttccgagtcatcggctagagagtatatttttttgtgccactgcgcatagatggccaataatgccgtgagagaaaattcggcgggtgtcgtaaccaagcagtcaaaagacgtcggaaccggagccgcggtttttatgggtgcctgtgagtcgggtaatgatagaacgcgttcgacgatagtgaatattctattcgtatttccccatttgattttcttggacctgcgacccactgttttatattcgcggatgaaccggtcttcctttgtgtaaatttcgatacgggagtcgaattccgggatcgtgtcgtcgtgtttaagagccgacaatttaatgtgggctaggtgcgcgccctcagtatactccatagccgtggatacgaggcgtgattcttctacgtgcacggcaccgtccgtttttagtagccccggacggggagcacatcgatcgcccggcagaggttcgcacgatataactaatcccgttgttgtgtctacgtacatatcgacgggtgcgaagtatgcatgataaccgagcttaattctcaattttgccagcgtcacggcgagcagcgctttccatagagcgtgctggtccggcctgcaagacggccaaactcccgtcacagatccggcactggccataatcgccagtgccgcgtcggttactgaatccggattcaatccccaagctctcgcgatagaccgtcccgatacgtttaccgtagagtaatgtgcagaatacgtaccgcactcatttctaaaaagcaagtaacacagtgcggtaagaccatcggtgcggtctctactagtccatactctatacaaagtggtatagcaaatacacccccggattttctgtaccgccacagtattagcctcagccattgttgacataactaggttcgctgcgtacgccttacaaactgtgaaaatctatagcgccctctacacgaggccagcacgccgggggaacttctgccaaaaccgtctccaggtccaaaatgtcgtggtatatgcccaattccgcgtccaagcgagatttcactagcgcgtaccacttagggcgtcgaatctcgtagcgcgttttgcggaacgacgctttgtttttcataaggagtgtgtaaagcgcgcggtgcgttttgatcgacgttctatctatccccgccccatccaacaaagcttctatctccgcctttcggagattcttaactttggtgccacccggaaacgtcgtcgcgctctttacaaggcgtaacccatacagtatttcccatgtgactttaaaaacagaaaaggcgtggttctcctccgtctgccggcccaagggatacctcgcgagaccacttaacgcgcttttcgttgttttgactgatcgtttagaggcagtacgggcatccagcagataacatcgcgtgacttccaataccgaacgaataaaagtatcgtactcattttgcatcacacgcagcatcgataatggatctaaatttttagctgttccctctaaagggttaatacccaacgaggtcgcccatctgcagcataaccgatataagtgccaccttccagacacgttgaaatcggccgttattgcgacggtacccagccctccatcgggcccgattattggtaagctgcctgatgcgtaatactgataaatacgacagaacacctcttcactataaagagcggccggcgttgcgcgacacgcttccaacatcgtaatatttataaattgttctctagtaagcggttctgccagtttagttaataattgcgcaagatcgctcggcgatccgtcatgtcttagatatttatgaataaacggctccaccatctcattgtcgatcagatcagcctggatttgaccgcaggcaattttacggaggtgtttcaaatctcgttgagcgataagggcgtctgccgttaaatccgctaagaaggcgcagaaggtttcagcgtccaattgagagtcagatccgtcaaatctgacgcttattagattcgcgtcaagtaaggcgtggagaatattgatgctgtcgctaagattgttgagggtgcaccgttcaaacaaatgcttgtacttaaatcgtgggaaaatgtataacgcgtcggcggacttgaaagtcggaacgcaatctcttctgaaattgttacacaacatattggtcgcgcatacgaattgcgccggccatcctcccccactggcgatgacgtggtttagtagcatgggtgtgaaaactggctccgaacgagctcccgatgcatctatgtaaaccaagacttcgttacggcgtaacgatcggattctacctaaagattgatagaccgaaaccatatcgggcccgtttcgcgtcggcttaatatacgcgaacatgctgtggaagtgggagctgataaaacttaggcctactgttactacggtagtgtagatgacaactcggtaacgagtccatgaatttatatcaattggtatatcacgggtggaatttaagaccaggacagaatcggtaaatatgaggcagaagcgtgccgccgcttccgagaatgaaattgtcgaggaaaataagcaaatgttcaacccgcccgcgagtcttctgctgagttcagaaaaaaacgtcgtctcagtcacgcttctatgccgagagtgggtaccgtcagccccgtgtttaggtgtgggtcgtacatgaaaacaatctgattggtcgctattcatgacggagagaagtgtatctgttcccagattgcggaggatggtacatgatctcttagaaaacccaggggctgcgtattcgcccacgatgacatgtatgttatcttctcctctcatgcttgccaacatatctaccagttgtgtatttattgtagcgtccattgctatgatcctcgggcaattacgtaacagagtcgttagtatcgaatcgactctggacagatgcctcatggttggagagtaaagttgactaatggtcgacatgacttcgtccagtatgatgatttcataccgtccgagcaagtcagggtctatgcgatgcaaagattcgatttggatcaacagtctgtaaaactctctgcctcgtatgctgtagtcactagccgtcaaatagttgccgaaccccgacagcccggcattgctcagtttgtcgaataatgtgttcgtaaaacttcgcctacaggacacaaccaaaacgctcgtgtccggattatataaaatacgctgcaaccagtctatgagagcagttgtcttgccggatcccataggcgcgcgcactacaagtacattgcgcgctctcgaggacagtggcggcggaaaagtaacgggcccgtcggattggcgctcggtcgttactccgggtctgttcttagctatccaatctatgagaccttctccgtataatatcctcgacaaagaggcgctacagacatagtctatcattttctgtgcggtcgatgctctaacgtcgccgagaccggtgctccgggtgaggattacgttctgacgaccagagaaccgtctacgatcgtcgctatgtcaaaaggaccgcgatcggaaggagcccggagaggagcagatcatatagactacattcacaaaaagatgtgggttgtccaggcggcgtgtttttctgtcgccgtcttggttttcctaggaaccctgatagctgcatctataaacatgaccgaaggtttcccatgcttttttgcggccgtcgtggactacgggatgacgaacgtgacgcttgtgcatacgggcatgaccaatccgaggctgggaggcgtagttcctgtgctgtttttccaaaccaaagccgtggcgtttctcttctattcggcgagcgtcgtttttgtatgcatcacgtgttatatcgccgtaggcgccatcataactagcaagaaacgagtgggtgctgcgtataccggaaggggcgcgttcgtcctttcacttatggcatcgccctcgacaattttgttgggtactgtgtcgatttggcttcttcaagcggtagttatagtcctagcccacaaacttattgtactagccgcggcggtttatttagtgcacttctcgactataacgtttttttatgggtatttctgtggaaggggcgttgacagtaaagtatatgcggaagacatcgctgctgcgaaaaacgtagacgccggtctgcacagattaattggaaacgggcgggcggtcatgatcaacttggtttcgatcgtatacagtatgcttctgataatggcgtctctaatgttaggcatgttactagcaaacagctttaccttaaagttttggcatgtcatcgttaccgtcctcataacttcctcagtcttaaccctaatgtatcttttagtactcgagttcctagtggcgcggtacgtgcacatgattttgggtgcgtacataggccttctgatcgcctatgggatgctctggaccacctcatgtgattatgtcaaccggttctacttcgcgatgggcgtaggagccggcaacttacgcactgcctgtcacagcgtgctggcgtttttcaccgtactgattgtagcgggcatgattgttcgcctaatccgggccgggttgtatcaccgtaggcgatctactcgtgcatacgccaaagccaggcagttacaaagaaatgtaaaggagagattgagacgaatgagtcggggacgcgatcgtcccgatagccgagctgaggacgagcgggcgcttacgcaaacccaatatagcgaaacatcagacgacgagactatatatgatcgcgtttattcggggtctgatagtgaatgggatgaataggaacgcccgaaacataataaaacgctaaatctacaagtgattgtcgcgcgacttatttatcactataacgtatcgttacattgttcccgaccgtccttaaatctgaaaagcgtctttcctctcgcgcaagtacttccagctaagacagtatcggaatggataagagggtcggaggacctaagaccgtccaaatcgacggtatcgtattgctcgtcgtcgagctcaattacatgtcccgttttggtcagaacggtgtttcgtttccgacagcgtcggaacagttccgttacggatattgcttggcccatacttgctgcacgagttcaccgaacgcacggtatccggcctcttctacttcaccgtagaatgtaacgtccacgaccacgggagtgatgaggaggagaacgggaatcgcttgttcggggtctattttgacgcttggagtgggttctccagtgtttccttcggagatcgtcaggcgtctacctaattcgccaggtcgtctgcggcggcctataaacgtggcgaggtgtgggatgaccgggttgctttcaaagtaattagaagctacgtagttctgaacgaaaatctgcttgaaatttggatgtcgtgggttggcaaatatgggcacaaggacagattgttctccggtactccagcatagcgggtgtatcgcgttcgtttgcagatcaggttcgccaaacagccatacgcgagaactgcagttcttattggaggccaagtgacgcgaatcaaagtcgttccgtttaatgtttgatgaaatggcgcggaagcgtgatagccccactttccagtcgtcgtcacatgtgattagcgcctcctttgccttaggaaaatcgtcaggtttaaaatagtccacgcaaggatgattgatggcgtataagaatcttcggagcgctgcgacggttcttgtttgtaataggcgttcgtaacattgagatagctcgcttcgacattccgggtaaaacgcgtatttggccctacactttatttcgtacgtttctatggagtggtcggggagggcaggcgtaaggattccgcgtgcgctgcgagggcataccgccatatcgagggatgctccgagcatcccggttctggcgtctatcatcagaccgcacgcgtatttgtcagaggcggatgagacggtgattgtctcgtccggtacgcgtgcattttcgagcacccgagaaggttcgcgaggcctgtacctggggttctccagacaataggtctctatgagcgctctcgcgagcggctcgttacgcgttccgaagactacgctttcgggcattccttgcgccgtgatttcggcaggtcttatgccaacggtgtttatccgtccatcggcggtccacttcaatgtcgatgcggtcaacagccattgtctaagtacgtgccatagctcgcagtccgcttgcggtctggtgagagtttctacaattttacaccagaaaagcgcatgattagacggcgacgttgcatttgcgcccgattcatacaggagcttgtcttccgcctctaggagagaagaatatgaagatgccggccaacgtccctctgaaatgcctcgtttgataacgtccgttatgtacaataagcggtgatacagcgggtgtggcgagggccccgattgcttcgggtcgacattccgtaatatatagtcgctgaaggtataatcgaccacaacactgtagcatacggtatcgtaaggtttggactgcactgcttctgcgtgctcggcgcaagcgaagacctttggacacgatttaaattcggactcctttttacgtttccgtggcccgttctcgccgagacggaacattgcggtggagtctatttccataacagccgtgtagcggccctcgcttctgagttcgagtgacagtaaagtgcaacgagctcgaaaagattgcttaaatatggcgggactctcaatgaatcaaatagcttcctgtgcgtcacttcatatccttctaaatatttctcaaacgcgaccctgtggtgagagccgtgtagctgcgaacgaatcttttcggctcgttcccacgggataccgattttggcagttaacggggtagctggaaataagtactggtacagcatacaccgatacgctaacatgtctaaaagatagtcggccggcatcattttatggtaataaaaatgcaccgggtttccggggatggcaaagtcccgcgtaaaattcatcccggcggctagaagcacttccatcagtgattggcccagtgcgtacatatctatagcgacaccttcatcactggacagttgacttgaaccccgctccaagcccgtcccgtttaaggctttaaccagcaattcgcagggctgcgtttgcccatgccccagcactaaatcaaatacaggtctaatgtttgctctagacacttttactgaatatactcgatcggagtctacagttatgtcgaatcgggctttcgtaatggtggagtttgtgttaagtaacgccaagctaaaatcgccgattacggcctccactataatagggttagacccttccctgacgttgacgaaaatgttcccgcacttaatatccaaatgagtcagtccgcaggacacgttcaagtacacaacggctctgccgaggcccatgaacgctttttctatggccctccaatggcgtgcagttttatccatcttcctcagtcgatggcagtacgagtccatgtccatgtcatacgctggaaataccagttccctggatggtatcgaaaaggccagtaatgaaatcacgctattgagcgctagagttgaccttgcccgacaagcgcattcgccggctatcagtgtcataagcaattcggtcttgaaacactcgaacacctttttgacggctacatttgcacccttaaatactttaacttctccatagctcccgcttcccgcatatattggcgtttcttgcaggtcgatggtgctgtaatgtaagcccggggagatatcgaaaatgagcgatgttatattctttatgcgagatagagtgaaaatatgatccggcaaagatggtcttgatagcaaaatgtcagatgttttcctagatatatgtttgcgtctcctatagaattgttttaggcatctcctaatgttgacggagatgtgttgtttgtggtccttttttctacacgaatctcttcggggggcactgaatgttccctgcagatcgtctgttgtgcttgagtatcccttaggcccgctgaagtcttcttggtcgctgatgtcggaaagccatttaacgtgaggacactcgtcgttttcgcggccgcgccccggctttctggctttgaggtcaagatccattttgacagcagcgcctcgcactctgcgtccaattctatgtctggaaggcgatcgctgatgtcgtcgctgatttgcgttaagatgtcttcgtttgctagaatgtcctcttcggcacgatccaactgtgactggagcctagggtttaaaaaccttcggttcgcatctaagacgatgcggcggtccacctgttcgtctatgtggcgttggataattctcgactttctatgagcttcttcgatccgcatgttcgagtgcaactgggttttgtagtcactgtgggcgtttctggctgacgttaacgcttcgatgagttctgggtcgtccgcttctacaccttgggacaaaagtgtcaaggtgcgttccttataaattttctcccgcgttcgacactcggccaatatttgacgcctgcgtctgcgtattgtgttaacggcgaacatcgctcgacgagattcgtagtctggcgattaccgactccgtaaagatgttcggaggcgcgctcggagaatcggcgaagaagcactttgaacgcctgctgagagataggaacgagcgtttaggtgcgagccgtaaaaatgaatgcctcgcgcgcggcgggagtttagtcgacgccccctttctaaattttgcgatttcggtcccaaggcgacatcagacagtgatgcccgctgtcggtacattgcatgactgctgcgacggtactggtatttactccgcgatcgctacacgcctgctgtatgctggtatcgtaagcagcgaatttggtgaagtgcgacgcgagtcgttatctaacggtcacatatcgaaaaggaatcgggaggcgttgcttgcgccgactctgacacgcgtcgccaattccataacatttcacgagtacgacgatgcacaatgcgcggcgcatcgcaacgcgtattacagtacgatgaacactttcgggtctatgaggacatctgacgcgtttcaacagctggcgtcctttatcgatcgattttcaaaattattagctgcctcgtttaaagacgtgaatattttggacagaaataacgctcccaaacgagcacgaataaccgctccctcgtacgataagcctcatggcacgctggagctgtttcagaaaatgatactgatgcacgccacttatttcttaacgtccgttttacttgaagaccacgcggaacgtgctgaacgtttgctccgtgtcatatttgatatcccagacttttcggacgcggccactagacatttccgacaaagggcgactgtttttctagttcctaggagacatgggaaaacttggtttttggtgcccttgatagcactggccatgtcgtcttttgaaggtatccgtattggatacacgtcacatattcggaaagcgatagaacccgtttttgaagaaattggggatcgtctcagacgctggtttggtactcagtgtgtggatcacgttaaaggagaaaccataacgttttcgtttcctagcggatcgagaagtacggtaacgtttgcctccagccataatacaaacgtgagtattgcattcaaaaccgttgtgtcggatggtcccccccctatacacacacccgtgatagtctaatacacccttgaaccagtatcgaactccacatctccggcaggtagaccaaatgccatccgcatgaatttacgggaatcttcctactgtctacctcggcttcgattaactcttcgagccgttctgtaatgcacgccttcgtgccgctattaccgaccactcggacggcatttaccgtgtccatgaataaaacgcaacagaggcttttttcccctttgacttgtatatctgtctgtcgggctttcatccacatacacggacctctgcaaacacaagcctgcccgagcgatccgcactcccatctcacgttacaaacatccacgtgaaggtcgaaatgcccacggcattccgcacagccgctccggtggttaagaaattttgctagagtagcgcccagagaacgttgctgccaaccggcgggacatatagatagcaaactctcttccatcctgaggtaataaaacctgcgtttggaaagggaccaccaagctccaatagatatcgctatacagttgtgtggatcgtctggcggctgcgtgcgttggactagggaatttatgtccggtgcgatacaagagatagttgacaaaggttctatggcgacgtccggaagaccgatacaggtcctactaggagcgacgtcagaaaagaaaataagatctgcggaagatccgtcgcgcagaatgggggttatgcgtaaagcggcagtcacggaataggcgcgcgtcccgttgactaagaacaagagttgaaaagtgtttctgtccaagtacatctcctttggtcgcgtaaggtacatgaatatctccacccatttcgtcttttgcggccgagcgcccagcggtacgtacgtacataacgtaaagtctaacgtggttaatgcgaccaacacagctagacgcgattcggcccgaagcgtgcgccatacgcaaatgcggtcatttaacttattaacgaactcaactgccgccgtatcgcaagtccgttctgaacgacgcggcgatccgggcgtccttcgtcttcgcgtagtcatcgtcccacatctgtatgacgctaccgctaattgaatattcgagtcttggcagggcgctcatggaaaagataatgtagtgttgctgctgcagaggcgcgataaaaccgcgtccgcccgcgccagaggccaattgaactcggcgccggcatgcgctgctaacatgaaccccgcgggcaacacgattgcaacgcgcatacgttcatcataacctacgcaaatatacgcataactttctccaggaagaaatctttcacacgttgcgcgcgatacgaaccattcggggaatgcgcaggttctaatagattcgtcgcccggcccgccgggcgacaaatgcgctgcgtcacgcaaaataactgggataggcctcttatttaacatcatacattctccgcccgcgctataataatcaaataggaaaagattcggcgtcctagtagcgacgggttggtagtcgcctcccaggacttcggcattgtttccagtcgtatgtatgtaatatgtttttcctccagtgcgcttaacatgcctggccagaaacgagatgctcgcggacctaagagcgcctactgaaaacttctcaggcgaagaactcgcgattgcctgtagaactgcgcgtactgaatggggtgtgcggcttgcgatttctgccacgcactgaacgtctcgcgcatacacgtcgtagctgatcagctgatatagattgggccctgttttcaacgcttccccaactgcccttatgacacacgcagagacatacgacttgaaattaatcattaattcggtttcggagcccggagaaaacgcacgcagttggttttcctctgcttttaataagggagcagccaaaataggagcttccgttgcgatttcggtctttcttctttgtggtagacgagaggggtgatcgacgccttcttccatacaagcggtagcgagtaaattgctcaacgaagatggaattgtggcagaatcggaggaacggccccctaaggcaatcgaccgctcatacgatataagataaagtgtttttttggtcatggagtgggtacgtggaacgatggatatgcccccgcacctccaccggttcgcaattgtgagcccgtccgccaaaatgccgaccgcagaagataggaggtctttggggcttaacgaattttgcgatggttcatcgaacatgagaatgtcttccaaattcaatgcagtccctgtagattgctggtccttattacggccctccaagcccctccgagtgtcgtggtttctggcaaaccttcctttgcccacgggctcgagaccatctatgacggctttctgtgacacgctgctactgggtgtgcacaaattattttccaaacaagctatcgccccttggcgcaatccggacactacgctggcgtgtatattctccgccggccgttttgcgcttaccggcgctcgcctggtgatagcctcggctgccttcttaatgagatttgcgatctctatattgtctgtctctagtcgcgtgtcgagagtaggagtgtcgaagacgttcggagaatctgttacttgccgcataatgtcaaactgaccgggcagttcgacggcggataaacacgcctctaatttagcccccaattctataacagccgacggtaattcgacctcgtatctcttagtatatcgtatgaattgacggaagagcgtctttaagcggttcgcatcgatatcgtatcgagtacctggaggaactaattcctcttgactaaacagtaaatccatgtacgcttcgtactctccggtttccctatcctgtacgttaaagcgaatagccacggatgtaaacggatcaaagcggttcttagaatcatattgtatgggaagactcatgaacaatccaccttgatcgtttcgattgagcgtcgcgaaaagtttggcgtggcccgggacatgaggtatcaagagtatgtgtagtgcgccagagggaacgtaggctgccggtgattcgcgccaaccggaacatttaccggtggcattatagcgcatctgaacacttaccggaatcggcagcgattggtaagcactgctgggtactctctgtgccgcatccttaaaacgggcgatatctatccccgctgccgacaaacactcatccggtaagaggacatgcgtcagtacgtgccgattggggccgtgtttgggagtagatagcgaatacgcggtctcgctctctatatgcgcctccatcctgcaccggaatggcgagtcgggtcctgcggtctagatagcgtcgcgtcgccgttaatgcgaggggctatgcctttacggaccctctcgactcagcattgcttgtttttgtttctgcagagcattcgcggccaagatttcaacttgctctttgtcgacgaggcgaatttcatacgtccggatgccgtgcagacaataatagggtttctgaatcaagcgaattgcaaaataattttcgtgtcgtctacgaacagcggtaaggcgagcacgagtttcttatacggtctgaagggatcggccgacgatctcctaaacgtggtgacgtatatatgcgacgaacacatgaaacatgtgacgaattatactaacgctacgtcatgttcgtgctatgttctgaacaagcccgtgttcattacgatggatggggccatgcgtcgcacggctgaaatgtttctccccgactcttttatgaaggaaataatagggggtatcaccatggatagaaacacgtgccagggagaccggggggtttttactgcttctgctgttgagcggcttcttctatataggccgtcgactgtacggaatcaggatatcctctcgcgagacttatacgtgtatgtcgatccggcgtttactgccaacaccagagcctccggaacggggatagccgtaatcggtaggtatggagcagattacatcattttcggccttgagcactttttcttgcgggccctgacgggagagtccgcggatgccataggagagtgtgccgcgcagtgtatcgcgcaaatctgcgcgatacactgcgagcgtttcggaacgataagagtggccgtggaagggaatagcaaccaagattcagcggtagcaatagctactagaatttcgatcgacctggcctcgtacgtgcagtccggagtggcaccggcgccacacgacgtttgtttttaccacagcaagcctgccggcagcaacgtcgaatatccctttttcctcttacagcgccagaaaactgcggcgtttgatttttttatcgcccgcttcaactcgggtcgagtactagcttctcaagatttggtttctaccacgattagcctgtccaccgatccggtcgagtatttgaccaaacaattgacgaacctctcggaggtggtcaccggcgcgacaggcacaagaacgttctctggcaaaaaagggggctacgacgataccgttgtggccttggtaatggcggtatatatatctgcccacgcgtcggacgcgacgttcgctcctataagaggagtcgaggccacgtgtcgcggcccaacagaagcgtgaccggccccgaagcgtgaaatatatctgccgcgtcgcaggaaaagctaaccaataagcagactcgcataagcacaaaccgtttattagaaggctacccgatgaataaagttattttaattccagttagaaataacgggacataggtctccgacttttatactcgcgggcccgtcgaacgtgcacactttcaatagcgggcgcagcgctagcatgtcccctagatgcagagccatggtaatccacgaagacagggcttcgtaaatgggatatctgcgccacgcgtcttgcaaaggcgggggtctcggaattctgatgagctgacctactgctctcgtggccgtctggagacccaccagggcgttgacgtaaccgtcagacgctcccaaagtaagcaacgtcggtatcagagcatataggagcatgttaccttcgtcgatagcgaaaatcatgtttagcaataaggttctcactgcagactccgacgcatccagactatggagcgtcggactaatggtataggttttcccgttatatgtaatggattccgcttcacggctcgtagggggaggcgctagccctccgccgatcgctatcccttccgtggctcgagatagcgtcttagcaataatttcacgtgcgagtctcgccggaacggttgatggaaataaaagttcggtatcgatcgattccaaccggatacgggagcaaacgttagggaaaagcggaggtatcaggcatacagcatccccgttacataggtcgaacgggccggtgttttgaagtgccaggcctgaaggaatggtccccattcccaaaactacagcactcattcgaccgggtagcgcgcgggtgacgacggccgcaaatcgtcgtttgtaggtcgatagcagactcagcgtatcaggttcggccccagcgatgtagtatgacttataatctacttctttgagcagcactctggctctgacggacggtaaaaaaagaactcgcccctcacatcgttgaagtaggttcgcgtcgcacgtagaaagcccgcaggggagctcgatctctactgtcgtaccattagaagcggccataacggtaccgctggcggtttattttcggtaccgacggcggcagcggataagtgtataggaaccaggccgagccgctgtcaggtcaagcacgtagaccgcggaaggttagcgatcggcgagctggcagttcagcatgcaggcaagcatccaccgatcggcgaagcgtctttgattaagtattgagccaagtgcgtttctgggttatccgcaccccctgcgaaatacgtgcggagcaaagctttgtcggtagcgcaaagtagcggataggcttcctgaaatagggaacaaggatcttcgattaattccgtagatccgactggtcgtttgaactgtacttctccgtccgacgcgaatgctgccacggcagaaccggcttcgctgattagtttatccaagcaccggcttttgcagcacacttctgccggggtaaaaaatttataggtgggactgaagaggggagacgccccgctcaaattgtaagttccgttatagagcttgtccgcgtaagagaatttttgcgaagcccacggattgttggttgcgcggaacggataagcgggatccccctgccggtgatcgtacatgagtttctcgatatcggatacttcctcgtccgaatgtatcgccccggccgccctccctctcgggttacacggggttcgaaagtactccaggtctgcggaaacgggtgtagggatgaactcgcatatggacatttggccatgttccagcccgtcggggagcatgggcatcagtgtacctagaaaggggacagttctttgcggagctgttctctgtccgcgcgttgctgctttccgtagaaagtcatcggcttcggggtttataagggggggcgagccccgtgtcaaatgcaggctttggacagtgttccccatatccgtcgtagcgtttcgtaagagtaaaggggtacaagtggccgtataccccacgcccaaatcaacgttagctcgtggttgtgtcagagaaaactgcaccccccctgcgtgcgggcgcttcgagacagacacctgtccgagaaaaaacgattcggacgcccgttcggcaaacaggcccatatctgctaggaacctatcttgtcgtacgacggtaaatgcaattcccggatggaaccccgttctcaactgatgatacaggcctataggagtgagtttgaaatatcctgccatcagcgcgtacgacatttcgttgggcccgcatctactttcgcatatgtactgtgccacgggctggcggaacgtagaataataattggcgcccaaaaactgtggaacgggaggagctctgccgagcagcgtacgcgcgttcccggccaactccccgactgccgttagatggtcctgacaggcgaacaaagcgttaactggaacgggatagaagtacgtgccggcagcgatcgtctcatcattgcatgggtaggccatcattaaaagcccatggtgtaacgcgccatcgaacgttcgcatatgccttgtcgccgatgacgtgccgcctacatccggggtggttccgtagagaatcgccgttgtccgctccgccatattgttcaccgtttcctgcagagttagaagcgcgtccgcatccaccaatattctggcgttgtgtagcagcacgttaaacgtgttggggacaagatttctagcgttcaacgggtgcctcgggtcttctgcgcccaggggaggctcctcgtcgggttggatgtcgggaatgatcacagattgagacgtagcgtagatgttgtcgaaacggatgcccatggtgcaacactgacccctggaaaatgccgggaccatcacgtaataataaattttcgataggattgaccattcatgggtatgatgaggcgcgaacgtttgtcgatcggcgtctcctacaggcctgttatggactaaaacgttgccggtgcgttcaaaatccgcatcctgcaattccagccacggccgcacagcgtaattttcgtcgcttcccacgttcaaatacaagtttctatcgcgcacgccgtgcgcttgatacatcagggggtcacagtcccacagtagggggggtaggatcgctctatcgattaaggcgtggtttaattcctcattactctgcccggtcagtgagtctgtctgaacggtataatcctttacaatcgaccgcagcgcgcgaacgtgccgcatcagctctttgtagatattcgtacagtcctcagggagttcaccgctgcataaataggtatcgatgaatgcgaccatgtgaaagttattgacgaatgctactcgtttgcagttgtcccagtaactccgtatacattgaatgatcagtcgcatcagtataccgaaattacgttcgctgccgtgaattacggcttcgattacataaaacgcagtggggtagctaacgtctgagaacgttgcacatacggcattgattgtggaagcgctcattttgtggcgactggatgcgagctcttggccgagcgcatctctaaagtcgctactgcagagaggtagcggaatattacagttgcaaacccgccaggaggcggcgatcgacgccatcacttgcggaacgttatgcggccccgggagctctacatctcccgggaccacaaaaaagtcaaacgcgggatgcaactccatagatagatgtggatttccggccgataggaattgctcttgactcatatggcattcatctacccaccggggcgacccgcagagcacgtctccgatgttctcgaaaaaccgacggctagcttcccgtagaggcaaggccggcgggttcgtcacatacgccccgaaaacacacgttaaatcgcgtctgtcgcgacgtaaatgactaaccgtcgcttcgatatccaaaaaggatgagtggcacacggttccaatagcatccgataaacatacgctaattatctggttgtctttgttatggaaatatagctcccgtggcgggaacccgcgcacatctccttgacatccaggcccgggcgcatagtccccaatatgccgcgcataacggtccgcccgtttctgatatagtcccaaaggcatcacgaacgttaaatctatgtgtccgattaaagggtactggacttgcgttgcttgataaacgcgccgttccatggcttctagaaaaattaacttatccccaatggtcaccaattccgcaggcacttctgccgtttgggggacatcgtcgtctccccgtacgacttcatctgtacgatcgatgatgtcgttttcgtcgagattgagaatatagcgtgcgatgtcgtccatgttgcgtatggctttgcccatcactacggcggttactaggtttgttcccgatattatcatttctccatatgtaacgggcaccctagcagacgtatccgccatgtctagaattcctgatagcagtttttgcctcaccatgctcgttgttactagtacgccatctacgaggcgccctttcgaatcggaatgggtcagcctcggcattgcaattgtctgatgagtagagttaaccatcttggcgaggaatgagactatactgtctttgctcgcaccggctttgctcatgatgaaggtatcgttacacactctgcgtttgagctctgataccaaattcgctcgcattacctgcccgtttacccttccttctgtcgtgctgcgcgaaaggggtatcagtagcggagtcggcggagccttttccatcagtattctaagcatctgatcgaccgtgccccgctcaaacgaatccaatatcgttctcacgtttcgagctaattgctgtatggctctcagtctcaggtggttagatattgccgttccatctaaagatacttcagataataatgcgagtgcttccgccgcaacgacaaaggccgcgcttaacgatcgcttgcatacgcgctttaccatgtaagtgtaaagcggttgatcggcaggatggggcccctcgcgcgcaatcatgggttgctgtatttcaaattgcacggttccttcgcgcatgtatagcagatcgggagcacgcgtgcagacgcatgcgactgagagccccgtttcgagaaatctgatcaaagacaatgtattgcagtaggttccgagaagaatatcgaactgggccgaatagcgtccgttgtcatcggaactgaattgtttgaaatagtcgaacatgcatcgatgggatgtcatttctatagcagtcaggagtctacctgtaggcgctaacgttgctcctacgttgaatggtgtcgaaattgcacacggtgcgattggcggacagtcggtcgccggaggacagcggcatccggccatggtcgtcaacgggccgcgtccgatgtaaggactaattgccaccgtgactatccgatgctatgcgtgatccagggcatctagtaacgtttggtcgcgtcgaaggtcacgttaccggctgttcgaatgcgacgcaaatgatagccgatattgtaggagagacgtgacgtggagaatgcgcgagttctagcaacacgaacgaaattgcatattagactttaacgatgcaggtttttatctacacaatgaagtcgcgagtgcgcgtgcccttatatgtgcaagtttccgcccctaatcagaacggaacgcacgtctttatcagtgctcgtgtccacaaacgagggaggagaaatcccagtgcgtccgacacagctactgtagcgtaggtgatggtagctcccattaacaggtataccacagctccgtctgtcttatcgttttcctctaattgtaaaactttctccatgaatctcggatcttgaaacaccatgcggtaagaaaatactccgaatatcaccgcccccaacgtagacagaataccaacgaagatttgctggcagttatccataggcatgacatcattctttatgtttctgtacatgtaataagtttcgaggagtaaggtaccatagaacactgcggtaatggtcgcgcccaggatcagaaaacgattgtcgtgcccgtccatcgcgtacaccagaaatataatacaacacgagggtcggagaacaaatgcagatagccaagagagcacaacataccgagtaaatttggggttcatgtcacagcttttcgaaatagtgaaaattgaacctgataagtaagaggacatcgtggcatactcggccgcatcttcgcaatcgatatcgtccgaaacgcgtgtaactattgactccgtgtcttgcatattcgtctctaactgttcatcgccaatatagtcgaggagaatatcgcaatcggtcggttttgttgtatggtatccacgcctgtaccaaggcatagtgccactcgagaaggaccgtttctggccacacgtaacgactttgtcttctactaaagaccacccggactcggtacagacccaagctagagctcgagaccgcggaaaatggatatcaaatacgaacagaagatcttgtatagaaacgtccacttttatatctcggaatgcggccgcatagcttatttcttctgcggtggttgtctcatggcggtcgggcgaccgcctaccgatgactcgcaggcagagtttgcaaaatttgggctggctcttcgaggcgatggagagtctaaacccttggcagcttatgtacggcgggaattgcttcgtagaggaatgaaatgggcgctgcctcccggcgacgatgaattattcatcgactgtatggcctttttgaatctagacggggcgtgcagtgaacgtgagatttgcgatcttgtttgcctggaaacgtatgatccggagatcacaaaacacatggtatccacgaacgtcatttctggattgttgatccagacggcgcatgagtcgccgcgggactgcgtgatccacctgcccggggccccacaagttacagacgcacattccaatgctgtgtacgaatgtaattctggtgcattcgtgctaacttgcgcaactttggtggaactgcccacgtctctgaacgatctcgtcgaagggttgtttgacggtgtccccatccccagagatgcgctctcgtcgaggtcgcttagtagacgaacgaacgtgattatcacgtctaccaaagccgcggaaacgacgactatacagcggatgcatgtcccgcgacataaacagaggggcaacttaaacaccatcgcagctactttgcgaccggtgaaaaaacacgcgcggtttagcccgttcgtgcaagtaaagtatatacctcgcgtactcaaaatatggagttgtgattcagatagccattcgccgtccctaaaggagttgcgggaattgttttgtaaagtggacatggtccgtagagaaaacatgtacgcagaatcgcaattggaaccagagtccgtcacaagtgaactggttctgatagtcgatactgtatttgggagaccgctcgcaccatttattggcgtcgggtcggaaaacatacgcgtctcacatttccaaaagttcttactgctccagggcgtccttatattaaatcgtttgccgaattgctacggaccgcttcgggagctgtgcattcagcatgcacctgccggtgaagagtcgcctcctctggtatccgactctgttatcgcagacatggcgaaccatatgtttagggtcgccgtatttattggcatggttgtggaaatagttgcgggatgtgtatcttttgcatcagaagaactcgaaacgcgatttcccagtgcgaccgcgtttacggatgctggcattctactgaacggcatagaagcctcgccgaagccaaattgcttgtcggaacttaaaacacgcaaactcgctcttatcctggacggtatttatagagacatggatcctatagacgttgctctacaggaatcggtggggctaaatacagcagagttattatccgcagcaatagatatctcggttatgtctgcatttgagcattcgggatggtgtagcggctacatggaacactttgtttcattgctagatgcccgtctgagagagggagggtgcttggcaatattccggtagctttgtagcacagcggcgagacgcgcataggcgtgccgggcatatacagaacgtaagccaagctggagtttgtgtaagtatgtgctctacagcgtgcgggaagggcggttcgcgaataaacacaacagtacaggttcgacggttagaaagtttccagagtttattaattagattggcccctcaagatcgtctttgcgtcttaatttctcatatccatggtacctaaagttgctgacaagcattttggcggtgacaatcgctatagctgcggctattagtacacccgctgcagtagttgcgatgtaggtcgccgagaggatggcaatgcgctgcgactcaaacgctaggatcctcacgactgtgccatttggatacagcaatagtgacgtgccatacaggttactggtggtggggttgaaatagcgcacggacgaattgcctgctgctagcaattcccgctgcaaatcgcgcgatgagatataaatcgcatgtcgaacgtggccgcttgcggaatatcgcagcagcacgcagccgcaatacggacattcttttcccagaggcctaggtaaaaccgcaggactgattatacctgatgtcgacgtgcacggcagcctggcatatgttatgtaaagttggttgtttacatcaacgccgtctacggtatacacgatccctctgaccccggcccgccttgttacaatgtagctacctataccggagatgggtaacaccagaagagtgtcggattctaacctatcagtgcccgaacattccaaaacctccgacgcgtatgtagcaactgttctccctattgatgttcgcagctttgcaattactgattccgccttggcctgcagatcttcttcgattctgaccccctgagaagtattctctaaatactcctctattactggacggtaaaccacattggccatcgcgtataccctgtgacgccgctcggaaatgtcgatcctcaatgatgtcatgcacggcgtatacgcgtccaaaatatgtacgggctcagtgctgcgagtgagtctgatatacatgtcttgcaccgttaattcagcggccgcgatgtgttcttcagtacacatcgatgatgcaaataacagagatttgcgtgcgttatgcgatgcgcgccattccatcggcgaccgctgaaaaacgctgtcgaatgcataatacagggcgtgtctcgtggaagcattccacgagatcgcgtccctgacggattcttcgtggagagacgtgataaaatttagtgcgaggtcggaaattcgcgccccccattcgcccttctcccgaggtatgtcgaacgcgtacacggaccggaataggtacaactgtcgcgcaatacctaaagaatgcgtccccctcgatacatcgctaattttttttttcaatacggatgttagtatagcagctttttcattccatacatgtgtccgcgataataagaagcacgtgccggggtccgtgctcggggcaaaattgcaaagtgccgcggcgattactttcagatctgcctcccttttaattaattcatcgagggagacgtagccagacttaaaagcggcgtgtacggacgcaacaagcgccagaaacaaacgcgtcgttacgatcctaaagccgtggatataattactagtagatgcgggcatagaggcagaaataaaaagccgggagtgcgcttgagtgatatgaagattataatctaataggtcatctacactcgaaaccatatctgcgtgggcctttaattccatatccgaggcgttctgatatgttcccagtaggtatgtcgaaaggagatgtcgagaggatccgttcatcgggtcatactgcttcatcggtggccacagcaaagtcatgttggtagtccccgacgataatattagttccacaggcgatgcggcttccatagagatcgtaacggaggcgaattgcactcctaccttcattaagacctccgcggtatttgaaccgaatatcgtcgtccgcacgtgggcataatctgtcgggactagtgtgtccatggggtccacgaagcatgcacgctttgcaaaagctcccgataattcgctgttgagaataaaacggttctccggagtgaagaagtcattcggctttatattttctaacactgttggcgggtttgcgccagtaggttgtgacttggcaccaccgtgagcttttggaccgggtttgtccggtgtctttttttcgtctcgtcgatgggataatacggctgccgtcaacgagtaatcgaggtccggcttcgcgttcaaaactttgatcaggttattagacgttagcagcctagatatcggtcgtttgaagaaaaccatttgcttcacttcacttattggtaaatgaaagagaatgccgctcgccggcgtagatgctcctatatatacaaatgtcgcattgtcgcgtacccaggacgtcgggctagtagcattttcatcggccgatgaaaagtccaattttacggacggcggtctccggatgtctagcagcgaccatacggaggggatattatccgaggtgggggctcccggggaagatgcgagcgctagcagtaataaggtgcataccgccattccgattacgcggcgtcggtcgttgcctctgcgtatcgctagttcgagctcgggtttccgaagcaacgtaacacacatatcctatagtgtacaatgtttcgatgcaactgaaagcaacgagctaaagcgaagatgttttgcaggcgacaagggcatgcattaatgcacactcgtccgaaatgtcgtagtctcaaatgtccatctccttattgaatgcctgaacgtccgcctcgatctcaaatacatcattccagctcatatgcgttattaatctttccgccattgaatccataagatactctgcacatttctggaccgacatgtcgctgacatcaagccgctcgacattgatgttcctcagtttcatcaacatcccccacaatatccacccgtataccgttaacaggctaccatcttcactgcataattctttccgcttaaaaattggcaaaagcgtgtgctgcaatgacacccggctaccatggtaacctgaacggggaccatctataaatgtagaggccatcgatgcatcaaaccacgggagctgcatccactctgtttcccattcgtctttactgtaaggacaaatgcaattcgcatacgcgacggtatctgctaaagccgaatatgccgcattgagcgccctgagcatgcgcacgtctgtagtttcccccgctctgttcctggccgataggcgcttcaggtgctcggtttcgtcgggcaaatgtgctattaccaagttgcagccgggcggttcgtggggcaaccgtgtaatcgcactaatcaacatttccagagaacaatcgccaatcagatgtcgggcgatgggaaagcagacggtagctgaaacaggatggcgatcaactattaatataagagatgggttgccccgtgttccggctaattgatgacatttagatgatattcgttcgtgtagtacaatgaagggatcggcaaatttggcctgcaaagccattacgatcatgctagactgaaatagagataattctccccgacgccggcgttcggaagcgtcattcacagctgcaactaaatcggtaaaatagcgacgccaatatttcagaggctcaaaaactttcagcacgggtactcccgtcgcagagtggctcggcacttcgtttaacatcgacgttttacctatagccaatggcccgtcgaggtagacgcggatcagctgcgcggatgtcatctgagagggcattaccgaccacggccgcacgtccgacatgtccggcgcgcaagaaaactgctcgtagacgatataaccggcggagaagcacttctggacgctcaagttaccgtgcggctgttaacctcaagagaactctagcggccggcgttcgatgtcacgcacgtttttaccaaaagctctacgcagaatctatgcaccttcgaactcaggccgatgattggacggggcgggccctatctaagattttaggaaaaattatggggtttgatgtatttaaagcggcaactgatttccgattggtctttgaagtaaatctggggcggcgaaaaccggactgcatttgcatgattaggtgcccccgcggtctatgggaggcaagttgtgatggcgcttgcgtcatcattgagttgaagacttgtaggttctccaataatctaggaacggccagcaaaaaggaacagcgcctcactggaacaaaacagctcttggattcaaaattgctgattgactatttagcgcccgtaggttcggagcgtattttcatctgcccgttactagtattcgtgtccaggagaaaattaaacgtgttgcgtgtaacctgcctcagaagaaacgtcgtaagtaccgatttccatcgtctcgcaactttaataacgcttgcatcggaatataagattaaacaggtcgacaggcgcagaacggctgttcggaaaccggctcagtgtgcaagaaatttcgcaagtcttgagaacgcgcggcgagacgatcgatcggaagaggtcgagatacacacttttcctaactgtagtattgtcctaccacctcgtaccattctacccggagccgcgaatacgacaatgcaccgtttggcaagtattgttagctgcttggtacggaagcagtaaccgaaatcaacggcaccctacgaccagctatgttacacggtgcaatccgcggcccttctcccgttactttcttgctccgcagcccttgtccaacgtcagttgtccgtaggcactgcagcaaagcatggcgagctttgcctgggatgcaagaattttgacagacccgggcccggaatctcacccggctgatgtaaagaatttcatagcacctccctggcctctgcacttctggagggaacctatatttagcggcaatcttggggatgcggaacggcaactggcaatcgttaaggcgcgaaacagtgccgcgattgcagcgttaactagtttggacgaccgtactgatttaattgcggtagaagtggagcgtcggcttcgaccactagaagataaaatggaacagatcgcaacgactttggcggatttggaacgagctgcttctgcggctgaacttgccgacgccgcagccgatgaggctcaaaatgtcgtcgattcgaacgaatgccaaaaaaacattggtagcgctgcgagtcgcgaggtccaaatagtcaggaacgatccgtcgctaagatacgactctaacctgtcggtggatctgctgaatattatctatgccagcaggggcgctgcgaattcgggagtggcgttcggtacatggtaccgtactttacaaaactcccttattgcggaaaatcccagcgctgcgcggaagatagattatcgcgatggaagaatgtcgcggaccttcattgcaacggcgataacgtccttacagtcatgtgggcgcttatatgtggggacgcgtaactattcttctttagaatctgcagttctatgtctgtatgcgttttatacaaaaacgggagctaatgtgtcccatccaagttcttttaagagtgcattagaatctgttcccatttatctggatcacatgtcagcgagcctcgctagcactgataccaggcaaatctacgggttcgataccgggaaattgccgaaggatagtttcgccgccccgtccggaaaatacgaacggggcgcgctaagtgatcatagcgtattgagagctctagcaaattctcgcgtgttgcctcctagtgcggggtcgatcccccgtggagacgtagccccagagctagatgccgaccagagcgttcgtaacgacgaagtcaacgctgccgccgcagcgctactgggacgagcccaacccctcttccttatggaggatcagacgttgctgagagccactttggacacaatcgtggcattgcttttacttcgccgtctactttggaatacgaatatatattcagctagagttaaaaaccagttccaactgggggcgttcgttccaggcgtgcctccagatttaaccgtaggagcctcagtagacacgccgggggatgtaattaagagtgacgggagaaacttaacctttttatttcagagatacgtagttcccgtatatagtgttgtcaaagggatagagctcacacaactctttccggggctggtagcgttgtgtttggacgtcccgttttccgatcgagggttatatagcaccaggacgccgccatcgcgtatcattgacgtttcgctgagtaaatatcaggcctccctcgtgaaattgatttccttagagcttcaaaatcgttcccgcgctaatgttgtatctgtttgcgaggtgatcgcgactcacgatttggtgactctgcagtatgagcgaggcttggaatcgctgatgcaagtccagcgtccccgcacccgcttttttgaaaccaagaaggctttggcgttcaatgtggaaacggattacgatctgctttatttcgtgtgtttagggtatattccgaggtccgtatctgcatcgtgaaatatacgcaaaatattggcacgtgtccagcttaaacaacagtttagtagaaatgaatccgacggagaaatattcctcggtatatgtcgccggatatttgtttttgtacggtgcagatgatggcagcgaactgcacatcgaccgcgaggatattcgagctgcaattccgacacctgctcctttgcccataaacatagatcatatacggaactgtaccgtcggagccgttctggcactaacggacgacgaacacgggctgttctttttaggaaaaataaattgcccggtgatgatacgcacgctcgagacggccgctagtcaggaaatattcagcgaattcgataatctcaaaacagaggagagggtattgtatttgataacgaactatctaccatcggtgtcgttatcttccaaacgtcttgaacccggggaaaaggccgacaaaagttttctggcacacgtagctttgtgtttattggggaaacgaatcgggactatcgttacatacgatcttactccggaaaatgccattgaaccgttcaggaagctttcccctactaccaagacggccctactatccgaggggcaagaaacagagcggctcttaggcgataaggtctggcatcctagtaaagaggcgatgtcaaccgcgttgttgggcaccgctctgaacaatatgttattaagagatagatggcgcactatttccagccgaagacgcatggctggtatatccggccagaagtacttgcaggcgtcagccttgaccgcactggccgagtcgatgacgtccaataacgcatcaacgatccatccaatcggcgaaaccgcaaactcggacggcatacaaaaggatgatcgaattgaagtgtgcgccacttcgccgcaaacgaacaaaaccttagagtccagagcattttcgggagggagtgggttcgccgggactcatgcgatctctccaccgccccagatgagcgcacaatcgccaaccgagatgtctatgaatactaaatctcatttcccccccggcgacgatttcatttgggttcctatgaaaagctacaacgaactggtgtcgagacaggccacgcacgcaattaatgcccccgaagctgcagtggggagccaggcaccgtatagttcctctccgttaatgattccggcgcacttgggacagcatgctcacattgggggatatggacatgcctccaacccgcaatttgcatcgggggccataaattacatgggcgggtttccatatgctctgcctatccaccccgttccaaccggccaatcgtctttggaaaccaagctgtcggctctactggattgtatgacgagggagaaaaaatcagtcgatggggatcgcggacgtgacgacatgttctctggccaagaagaacgaggccggcgcgggcgcaagcgcccgtacaactgtgacaaatctcccgagcaggaaccttattatccaggcgaattccagcagtccgagcatcgtaacttaagatgcgaagacggcatcgaatacgggcgagacgcgactcaaacgaggcccgccctggcgggcctcgtgaacgctgttacgtctttgcagaaagaagttgaacggttaaacggaagggcgcaagcccattcgataccggccgtacagcatatgcaaggaatgggaaccggattccaggcccccgtatactacgcataccctcctctcccaataccacatgtattttcgcggccgccagaagacggccgcccaatttcttccggggagggaagggcctcgctaggtagcgccacgggcactcctccgtctggatcggtacctccgaacgcttctcaagaacgtgtcgatgcagctcctaaaagcgacaccgttcagtcgcaagatactgtgaacgccagtacgatcgccaatgtacatcgcgccgacgatgcaggcgcggatattttcattaaacaaatgatggcttaaatgatggcaggggatccgctatgtcgacgtataagtttatacattttgcgaccgcaatagcaaataaaagtaaaataatcgtatgcgcacgtgagaatttatttatcgagaaacagcatcgcgctaaacggcatcgtcctccgaatcagagtacacaggcgataatctatcgtagtgctggccactactttttagcctcagctttgttaggtgattagaaagaatagcagtggtgcctcttgtttttttgcgcaaatcattttcgtggcgttcctctgcggacaccaacgccatatattttatcatttctcgagccttctgtaatttttttttatcgattggtgccttttccgagtccggttcttctccgtgcaactcgcgcgttgcctgggactttagctcttccgtcgtcactggatatagggctttcatcgggttgcctctaagcttgtttacgtaccagtaagctagaaacgcagccacgagtcctgctataattatcaatcctaccgctaaagctccgaacgggttagacataaaagcggacactccagatacggtagccaccacggcaccggcggcacccacaacgaccttccctatggcctgaccgacttgccccataccgttgaacaattccgccaggccgttcataaaagcgtaatttgtatctacttctattactttatttatgtcataaaattttagttcgtgcaactggttgcggcgagccacctcggcatagtccaataccccgacatctcgcaactcctctttcgtgtagaccgacagaggaagaatttctctgtcttctaacagtgttaagttcaggtctacaaacgtgctggctgtctgtatatcagcaacctctaccatcttaacaaagttatagtcttcgaacagagcgtatgcggatccaaacaggaagtatctccgctggttagccgtacacggttctacggcctccagtgttgggagtagctcgttattttcgccgagctggccttgtatcctcccctggttctcgccatacgaaaacaagaccagcgggcggctgtagcacatattagtagacgtggcgaccctcatggaattctgcaatgttaccgattccgcgtcgatcccagtacaagtagacacggcggtcacatcccctaacattttagccgctacgcgtctccctaaggtagcgctcgcgatggcgctcgggttaattttcatcccttcctgccataaagccagttctttattttgtaattcgcaccaggccgtggcgattcggctgaacatgtcgttgatatgagtctgtatatggtcgtagagaaattggagcatggcgaattggacggacgaagtagatcttatcgtagcgccttcgttcagcgccagtttttccttcggcgcattacggagctctcgccgcaaacgggacaaggagacatttgttttattggaaagagcatgcttattatgtactaggtctagcagctcgtctgtcctgttgtccctcatcagttctcttagatacatgtgagccagagatttcgacataacgggctgatacgccacaagaaatccaccgagggccaaaaaatattggaccttcccgaccttgacgtggctgtcgttatatttttgcgcgaatatgcgcttgattgttgtttcagcgtcgcgctttacgcactgacctagcctgatacgatccggatcgaattcagtggtattgctgataaatgttgacgatagctcgcgggccatgaatctatacttgccgttaaccgttgcgcgcaacatttcagtaacatctttccatttaaccatcgagcatacacgagcggtctttgctgcccagtcccacccaaccgtaaaatgtggagtgacgaggaagttacgcttgacgggtatgctcgccttctgacgcttgctcagatccattgggaaatagccgtctatctgcctaaattgttctagcggatagcccatgggttcggcggcggcctcgggcggggcgacgccataaaacggggacatatttgcgatatctccgttcgccattgcaaaatacgagtatgggaatgcagccctggcatccatttcttccactatgcagttgacagacgtccccgtccgatatacccacggagacccccatacggtataagtgtcgttggtcgtatgccacgccttggactcgggggtgttgaattttgacggttgtagaagtacctgtttttctccggcgtcgccgtcgtatgcctcgacgtatacattgtttctcaggtatcgcgctttggaggaacatctccctttcgcgtcgattacatccgtaatttcttcgatggaaacgggagtcctatctgtaaacctgttggtgatttgtctgtacgtcgtcccggtccaggtcgtcgtttgtataacgttcttataataaagcgtgactttgaatttgtatgggtttatattctctttgaagagtatagcaattccttctccccattcggtggcctttagcggttcggggcattttcgcggcggttctaaccggaccacggtcgtaccgaccgccggtgggcagagaaaaaatgaggactcgtcttcagacagctgtacgctcgagactgcttcccgcgacgttacgttttgggccctcgcgactcggccgaagaagtagaaaaccacagatatgaaaagtggaacgcagatcccactgaaatggttcattacgggttgatcttaacgagtctcatcgatagtgtggaaaggcgcgccgcggtacgaaagatatcgcactggtcaagtgggggtgtggtcatggtttgttcgttccgcacgtatctgatccgcagccgcgggagccatgtactgcagaatggaatagagcagcgagaaaacatccgcatcaaggattacggtcacgttgtctgattccgcaccgaggaccgttatgagagggcattctgtttcatatgtgacgtatattccatcctcccatatgtattccacgttaacattgagcggcaagcaatctgcacgacgcaggtgcaattcaccgcagctgaacgcggaagaaaataaagttgtcgccaaaatcacctcttttatatatttccaagccattctatgggccgcggttatactatctatgccgtcgaagtcgtaaaaccctctgaatttactgacgatccagtcagacgaactgcaactatgaatcataaatcgcgctatttcctccttcaaatgcggcaatagaccaacgttctctacactgaaatatagcgctgtattcgaaggttgggcgaacctatgtacatcgtgattaaacatcgggccgtttaacaaccgaaaaaatttgtgagttaggctggggagcatcgcgggatctattctgtgcttaagtaatgacgtttgcatgaaacggtgggcgtcgaacgcatcagcggtgatgcgattatcgatgatattcgtacatcgtttcctaatggcttccaataacctattcctggagcggaacccattgaataatgtcgtgtatgagtctatcaatatttcaccgtatacgttaacccgcagcattttttccagctcctttctttgctctgtaatacatttatccaaacttgcgagggatcttttacttaggcgctctgcgtacattttgcgtctccgagcaacgtcagccgatgccgatcgtaccaactctaaccagtcgtagtgctcgcggacatcgggtaacggggtaaccccttcgcgaatccgtagatgctcggagttactaaaatcgtcctcgggcgcgccgtcgccgtcctggcataggggaccatttctcgtgctatgcgaagtcacttgttctaaagtagtcttcagcgcgtcttgcgccgcctcctccgggtacaataaacgttttagcagaggagtcgacatatgatgatcgtaacatgctcttatcagcgcttctatgatgtcgtctggcgctaccgccctaccccccagaagcaatctgtcggccgcattcatattctcgatttcttgtgcaaacacccgttcgaaatgatccatgcgccgcccgaataccgtcatttccacgacggatgttctcagatcgaaaagacgctctttgaatgctaaatcttcgaggttgtccgcaaacgagtcaatcgtgtttgctctcggttggttaggtttgcgttcggacgaggcaatccagaattgcagctcgctaatggcatacagattccccgatgccggcaaaaaaacgttatgcgcgtccaggacggcggttgccgcatcggcgacagacactgtatcgccgctacctccgggatccttgtctccccttgtcggtctaatgagcgaaagtgccgcttgtacaaccgaacgcttttcgtcggacagacaagcggcatgtgggatgtgcgctaccatgtcatctgggtggacgcggagaacgatctgcttagttacatgattacatatttttccgattatgcgcttatgtgccgagtctccactgtttgccgtcacgcatagttcttcaaaacaaacggagcatggttgtgacgggtcgcacaactccggcgaaacgaccgatcccgcgcccagagtttcgattagatatcgatccagggccaacataaagttttctgcggttcccgcttttacgattaggtgacagtaattgagttgcttcaatatgttttctacgtcgtgtaggaatttaatctcggtccgcaccgaaccgccgtaagtatccaattcgacgacttcgtgatacggacagtccccggatatggtcatcgacttaataaaaaagccgtgtacatctccggtgtctgtaaactcgcacagcgcacgcagcagcacttctccgtctagtcgagctctacgcagagctaaccacaaaccgtagctaaggggactaatattcctctcgagttgctccgtcagcccaggagccattaggttttccaaatagcgtaccatgagcacatttaatttcagcggcttgatcattcgcacacctactctcggatcgcatctcttcagcagctctacttgaaacaagtacgattgcaactgaccccatacagcgagcagtttctgactagcgaatatactgtctcgctcaacgtctagcgcttgtgcgtttccgtgaggcatatccaacgtctcggttcgcctcgtctacgctgaattggacctgagtcggagggagagcatgatgatatttataggggttagccgataacgccccatccggaataagacccacaaagcgatataagaaagagtatgctgtatatttcatatttccgtatacaggttgaaaagccgacaatgacgtagtatctatcttgataaggctatgcgagcaggccccatccgggatatgagctaggtagttcgatacaaaagtaaacgcgtttagacccaaacacagattttaaaagcccgcaacccacgtactgggacaacaatacacgcggttatagcatatccaccgatagtcctggagcccgcttttcgggaacgggctccaagtcaaaaacgtccgaacacggacgtttcaaagttggctctaatatggacgggccgtccgcgcgtctttccgtattctcatcaagagcatcgtaattaaacgtaggtccgtccagcgggagagccttcgacatatcgaccatctctttcgctaatatcgcggcagcatcgacactccaaccgccctcgcatccctctacctgcttgttaagttcatctatcaaagatgagatgtacgcatcgttagttatttccatccagtcatccagttccatttgccgtacacgatctccaaccattttcaacgcgatcatatatacggcggcatgaggcgctccgcactcctcagataaaaccgcccgggctctatccacgagcgtggtttccttcaagcccgaggaaaatccagtctgttccgatacaaagccgaccctaggacatgccatgacgaaacggtgggttctattaaaagacattatggagcagacgtttctcccacccattatgttgccccagttgccggattggaatacttttgtgctaccggccattccgtgatatttactgatgctgacggctatcacaacaaagggtttagaggccatgataggaccgacgagattagtagatgaaaaggcagcacaccatgcttccttatgatcacagatattttttagcagttgctgggcggctggtgccacatctgacccttgtgtgaggatatgttcgatccagggcaggaccatagccggatccctaggtcgcttggaggttgcaaccaaagccgaaatcgtgttgataaagaaatgcttatgtgaacagtacctcaggatggtattcgctagataaaattgagccagctccccgaagcatgtaggactgatgttaatgtaattcatatcggcgtagctattggtaaaccttttaatgaatgacgtgttctcctcggcatctttggagagtataccggccggcaactgattgcgttgtaagaggatccaaaaccagagagcattgggagtcgtgccattaggcatcttaacattcggaaaaagttgcgtgtgataccgtttgagcgcaaagccgagagggccattgagcacatgcatcgcttttgccggccgttgatacgcttctatcatgcccgccagccgggattttgtagcgtcggagacggtactggaaacgcctccgacgaacataactttattcttcactttaaattcccggaatatctcaaatgtaactttcactagatctccttccatgtgcaccgccagcggatcatgctgagatttgctaggatcgggaacggagatttgttgatcctctaaggtcaccgttatgtttttagatgtgatgaacccggcgttttgcaagtccagtacgcgccgcctgagtaccgcttggaactgagtcctaaaatttctagcctctacttgttgcccgtgcattatcatagagcactggcttaacgccatatcttgaacgacggcaattatcgtgcgcctggataaaaatgagagcacgggacatatgcctgacgaatacggctctattgccagcgaaagggtatgggttgcatcacctagcccttcgcgtatgttatattctctgatttctgtcaaatttcgcatcagctggccagcttcgctctcgattatattagccattgtcgatagagcacgcataaacgatttgccatcccggatgatggcatctgcgggtgtcatgtctgctgggtcctcgcatgtcagcaaaccttctttttctaacgctttcattactctttcgaccgtcagcttgtacgtgtcctgcattacactgcggctcgtctctccctccgatcgtttgagagtcgagaatggggcgtagcttcccagcgcgttcacgtcgcagtagttattcgtcatagatccaaagagccccatagccccacgcatctgatacccgaatttcggcaatcgatattctaagcgcttaattgtggtatgggcgcaataaatacgcgacgctttgtcgcacaaatcgcatggtacgtccgcgtccatggcagatgaaacaaatttcacggtatctaaatcgtgatggcaagcttgagatccgccgtcacacctctccaggtagaacaagaatcttgccagcaattgcggacaaaacccacacgccaaaattaggtaatctaacgagtattccgacgggctggccgatgtggctttggacaaatcttcgcccggaatcggcttgccgtctctatcgattaacgggtttgaggccaaatgcggcgcggctatttggaaaaaccgataaaacgaggctgcggtcgtacttgtgtcttttccgtctgcgctactcgcttctcccacctcggtcatgtatataaccgaattcgaactaaacaccattgccccgaccagtcctgccacgcgggccatatacgcagacagcgcttccactctatctgtatatccgatcggactgcaatagaggggccatttctttacatcgggtatagactcctcgtagaccgatgtcgcgattacgttttctatggacagagtagcgtcggatgccattagagaagccgtcctacgttcataccccccgccagatagctccatgccttcctttttccccgctttatactgcgatttcgaagcagattcgatgggagtgaatgcgttaaaagctgtatctgcgggtaacaatgttccctcgtgattttcgtcaaagcttaaatgggcggcacagcgcgcaatcgcgtctacattgcgaacgcgaaggcctacggccgcggtactgagcacataaccgtgtaatagacgacataaggaatcattatagaaagcctttggcataagagctccctcgcctagtgctctaggcttcgtactaaatggatcgctggcaacgcggttgaagtccgggaaaaccaagtgcaggggatataacggtattctacgaacatcgacgccattaatgctcacgactccagtaccaccgtaatgtaaatatgagttgcagaggtacacggcctctttaaataattcggtcactactaagtagagcatagtttcttgaggattcattccgagattatcgcatatttgctcgccggttgtttcgaacgacgtggctaccgggggcgaataggtgctgtagccgaatcttcctcgtgccaaatcacatgctttagtcagattcggagccttcgtgcacggttttatacattctccgccgtgaaacacaaacacgcacggatggtaatgcgtcggaacgagcttgagagtagttgatccgctacccagacccgttgtcttcgttcctgcaacagctgccacgttccacatgaaatccgcttcaactgtaagacctgaaacgagaggcaatatcgcatcctcgcagtcattgctcttggccgcgaagatcgagagatcttcagctggcatgctgctcgtgggtgcagcatatacatatcctatcggccccccggtgatcttaacgcttttccctacatccatggttaaggtgtcagcgtttatccggtagactgtacaacggaatggcaaggggcgatgtgccttccaaagctgcgaacgccggcttcgccaggagatggcactttgactttctcgtgccggatgttttaaagccagaggacctccaaaggatatgacgcaacacttcctaaagtgcgccacgaaacacgtcgcgcatattgtatgttttataagtcctcgacttcaaacttgccttctctgtaagccgatatgtcagtagatggggctagaacttttttcaacccgtacctcggtgcacgaaagaggggacgggatgaagatagtaccataccgccgctaagtagaccgcgggacggggagagataccttcggcaacatcgcaatgcgattacctatatagcgactatagacgaatttaaatatatcgcccccaaatgcttagacgcggcggaaataaagcagcggggcactcatatcggcaaattgaaacgctcgcctatactgtacaaaaacggagaggaacgtgagttcttgaatttcgaggctttgggggacgcgtggccacggagatgttttagctggaataacgtatcattcttacccacggaattcgacccgcgtttttctaggtttcatgtgtacgatatgattgaaacggtagagtttgcaaatggggcaacaggcagagataaaaaccgttttctggagctattgcggcctatgggcacgattattaccatgatgggaatgactgaatgcggcaggcgcgtggctgtgcatgtctacggcgtcaaaccatacttctatatgcgtaagatcgatgtagacaccgcctgcgggagtcgatccacccgcggactcgctgagcagatggcgagcgtggtacgctcgtctgtgaacgaaagcgcaagaaaacgattttacggctcaagcactgtgacggccgactgtttcgaagtggacgtggtacgtcgtaaggatatttatttctacgggacagattgcgaagagtattaccggattaggtgtcagagcggcaaattcgttgcgctcatatgtgataactttcacccctccataattaaatacgaaggcagtgtcgatacaattactcgaatggtgctggacaacgccggatttagtacatttggatggtattccctaaaaattgggaattgcggtgagaaagtacaagttcgagcgccccagcaccatgttacttcatgcgacatcgaaattaattgtacggtggacaatttgattggtcatccagaggacgatcactggcccgattacaagctcctatgctttgatatcgaatgcaaatccgggggagcgaacgaatgcgcatttccggtggccacgaacgaggaggatgtagtcattcagatctcgtgtctgatgtattcggttcgacaaaagcaattagaacatgcgctgttgtttgccctcggttcatgtgatcttcccgaaaccttccaagagacgtttcgtgatacctatggcgttttgcccgaagtcctcgaattcgacagtgaattcgaactgctgttggcgttcatgacttttgtcaagcagtacgccccggaattcgtaacggggtataatatagtcaatttcgattgggcgttcatagtgaataagttgaccaccgtttacggtattagattggacggatacggggttattaaccaaagagggacgttcaaagtatgggatgccggggcaaacgcatttcaaaaaaaagggaaatttaaggccaccggaataatcgctttagatatgtattgcatagccaccgagaagttgaagctgcaaagttacaagttagacgtggtggcggaagccgcgttgggggagcggaaaaaggagctgtcgtataaagaaataccaacgcactttgcggcaggtcccagccaacgtggaattataggagaatactgttttcaggattcgttgttggtagggaaattatttttcaaatacgttcctcatttggaactgtcagcgatagcaaaattagccgggatattgctatcgcgagcggtattcgatggccagcaaatacgcgtgtacacgtgcttactacggttggcgggctcgcgaaatttcattctgccgaataagccgcaggtgcgtgcgggaaccgagttcgaaaacagcatcgccagtacggatgaatttgaaggcgaaccttccccttcgaatccaaaggcatcctcatcatttcatggaaatggcggcagagtcgtcggttaccaaggagcgaaagtgttagatcccatttcgggattccacgtcgaccccgtggtagtctttgattttgccagcttgtatcctagcataattcaggcacataacctgtgtttcaccaccctaataaacgacgacagaaaactcgccgatctacgtccacgcgatgattatatggaaatcgacgtacaaggaaaatcgctgcattttgccaaaccccatattcgagaaagtttactgggtatcctattaaaggactggttggccatgagaaaagcgatccgagctaaaatccccgctagctctgatgatacagctgttcttttggataagcagcaggcagccatcaaagtggtctgcaattccgtgtacgggttttgcggtgtggcaaacgggctattaccttgcattgatgtggccgcgaccgtgaccacaattggtcgtgacatgttgcttacagtacgtgactacgttaaggttaagtggggaaccagagatgccctcctccgcgaatttcccgcgctgacgaattatatgttgggcgacgattactccgtgagcgtgatttacggtgataccgattcggtgttcattaagttcaaaggggtagcgatacagggcctcgtcgcaaatggagacgatatggcaaaacgcatatcgtccgatttatttcccaaacctatcaagttggagtgtgaaaagacattcgacaagctgttgcttataacgaaaaagaaatacatggggacgattcacggtgggaggatgttaatgaagggagtggacattgttcgaaagaataattgccgcttcattaacacatacgcaaaaaagttaagtgatttgctatttcaggacgatgcggtggcaaaagcagccgccctcgtcgcggaaaggccttcgtcattttgggcaacggctcccctaccagaaggcttgaagcccttcggggacatattggctgaggcatacggtcaaatgacggcaagcacgttgtccgacgtgggagatttcgtcatgtcggccgaactaagtcggccaccgcaggcctacgctaacaaaagaatagctcatctcaccgtgtatcacaaattggccatgcggtccgaacagttgcccatggtaaaagaccggatttcctatgtcatagctgccgcaacgccggaggtactgcgcgatgccgagcgggtagcagaagccagaggggaaaggaaattccgctttagcgaggtctctgtcccggaggttccagggacgtttagcaacagcgccaagacgcgggccgtccaaaaacccaaggtattgatctctgacatggcggaagacccgacatatctaatcgaaaacaatattcccctcaacacagattattatctatcacatctattaggaactctatgtgtaattttcaaggctttattcggcaatgacaccaaaacaacggatactgtattaaagcgatttattcccgaaacttatacagaggatcgcgcctacgcgacgcgagttgcgcgcgccgtctttgcggagatacgcagcggggccggtctaagttctagcgaggaggaagaaactcttcaaagactgaatagagctttccgtattctaacagaagttcgccgtcgatattaatgtcgcatagcttacagtacacgtcgtcggcgttgacggctgggacatcactcgaatctgtttgacgatcgtattcttttctaatgactaataaaaagttaccgcgccacacgtgagcgattatgctgtaattcttacaggccgtttttaaacaatcaatcaatttgtagtggaggtggagagctttcccggggaacacgacatacatcatgtattcaagggagcctgcttcctgatccaagtaaaacaacaccttcacatttttcattccagaatcgagtagcacatagtatgcgaaaaaaagttccgggattgccaaaatacgagaaagggcaatttcgctatctttcccccgctcctctccgcaccccattctgccgcccaaggccacgatagaagccatgaaattcctataatgataaatgttgtttatctgttggacatatgccaatatcaaagaggcacgatcgtttcgccccaatcgcgggtctccgctagccgtgcacgtagggcaacagccaccaactccgagataataccccattcccgacaaagacaaacagttatctgcgacagcttccgacatattgaacggcaacgagactggcgttgtcttgatgatcggcacagccaaatccttgactaccattagttcctccgatggggactcttcaacgaaatcgaagtaagcgcgatacaaatcgacatctggttttcgagacccgcgtttcgtaccgcatgccggcgcttgtagatctcgccattgccgccgcgaccgtcttgctatccctccgctacgccctacagatctgcgtcgtatgaaaatgcaaccggtcatgccgggaattacgatgtcacacgtaggtttgtagcgtgtgctcgagagatatcagggatatagagtgtctttgaagaaatgcgccagcgtctttgacgaacgcggataaagtagtcggccggggagggaaaacctgatatgtcttgaacgtgtacgccaaggcccaaaacccggcgcatacgcgaccttcgaaacggttatggcttgcgagccgagctttatggagtgccaattcttcccggctcgctaggtccgggtggtcgaacaatgaccgtggattggtctgcgctatccgcgcagcacacatcgggtcgcaaaagaagtgtttgtagattgcttccgttcccgtgcctttgagcagcgccacgaagtatccgtcatcttcaaaatcggcatttctctcctgcgtcccccacgcctccaacaccggttctatgctatggaaaatgccgatgttgttagctgaataggcaatgatatcgcgcttaaattgccgcattgcaagccagtacgtgcggattagtaggaagttgcacaataagcattccgcggacgttccccctttggttatcgcgtgctttaattgtgttaccattaagggtcctaactccaaatcaggttctgagtcatcttcgtaacagtgactatatgcccgagtcgcccctctagcaagatctattctgttgtctttccaaaacttgctgaccgtctccttcctaaatttcgctgccataagagcgagttcgctcgccccatctggtgcagatcccgtgcccgaaagcaataataggacgagattcgtataacccatagtagagtcctcgccgctcgaccgttccgtatactgagaccgattagtgcacggtgctagtgcaccaagatcgttctccccgtcaggcagtgctttgctcaaacgaagctgcaattcgcgctcgtaaatatcgtcgtccgacaatgcgcgtataatgcaactttccgtttgagaaaaattacattctacgcttctcgcgcagtccttccagcctgccaaagcgacggaaagcgaggtgggaattgagccgaccgtttgacccgtttgtgggactttccttttactttcgtgtccagctgccgtgtcgcattggccctcgtacgacgagtgacccatgtcggacaccgtcgtcaacatggcccgcgtagcgctttgggccaaatacgaatagttactgtacaacactttagcgtcacccgcgcacagcgaccgtcctcttttccccgccgaacggccttgatttgcacggggcacgataacctcgttatgccgtcttcccggtacccccccgtcagttcgaaaacaaccatgcagaaagaagtgtctctggatatcctcaaaagttaaatgctttctcccaaacgagcctaccaacgtgcaaccgtgatcgaccagaaaatgcttatccattatatacacgaattcgaacgctgctataaacattgttgtagcgcatggtggagaaccaagacatttggaacacaaaaatgcgtaatcggccatccatatagccgataatccgaatttgtgcttatatatatctaaaacacggcaaacgagacattgtctatctagagcaaaaacctcggctgccgtcccgataaacgtcgccagctcttgatgctcgattccgtcttcgcaatcttctgcgctttcgctaccactgcaactctgaccagcctgaagactgttggtcttaatagcgtgggcggagagtagcaattcgttaaagagcgtatcgttgtacgtcaatatttcaggatcgaacgctatgtaagggcattttaaggactcctcgacccatccttccgacgcggatgctcccggagatcgaataaacggtagttcgacagtacgatgggccatggccgctgagacaaacactcggcaagtagatacgcctcggttagccgacgcgatcccagacgtagagttgctgtcggacgatgtcgataaattagctgaacgctatatttgcgacgggatcgtatatcgcgtatggttcgaatacctaatacccgatgaattagatttgattttcccgacaaccgacgggaagtttaattatctatcattcactagaagacttgcttctgccatccgacatggtcgtgccggagctgggagtgcgacccctacgtcgtttatcagtgccgagcgtgtctgtgaccatggggccgttttgagagggcggagcgagagatttgcatccgtaattaataggttccttgacttgcatcaaattctgaaggattgttagaaactagcaagccgaacataattgctccgccgtatatctttttttcttttacgaaggcatacagcgaatgatgagcgcgcctcagagtaagccctgtcgtcgtgcaggactaatagcacggatcaggctcatcgtcggcggagatttaactatgggcaattccgatcccggactcgcggagtctttttccggtcgcgttccggcacgttgcgtatttcaattcagtggggcagacggcgtggagagcgcgtttcccgttgaatacgtaatgagaatgatgaacgattgggcggggggtgagtgcgatccctacattaaaatacagaataccggcgtctccgttctaatcgaagggtttttcgctcctccgacaaacgccgctagagcgccgctgtgcgccgacaaagtgaacgtcctgttaaacactaccgattctacgggcgtcgttttatctgatatcaaaaggtttaaaaaatcagtgggtgtggattgcaggcctttccaggcttgcctaaacgttcattgctttgtaaggctaccaaatgttcagctggccttcagattcgtcggcccgaccgatccggccagaacatcaaaactgctcgactcggccgtagcgtcttacaattcgaaagcgaaacagcggttcaaaaacagttcgagggctatcgataacgaatcgagaccctgcgcacttcatgagtgtgttccgatcccggtaagagatgaaacgcagaaactgactagccaatctgatataaggacccctaggcgcgtgctgaccatactcaagaaaatttcgagcggtgagtacgtaacgaccgtacgcgtctcgatccgcaaaattatactgtgcctggtcagtgtattcgtagttataaccgcctggtggtgctacccgctctaaaacctcgcgacgcggcgtcacgtttccagtcggaacaccgcaccacagagtcatcatcggcgccactacatcgcgcgagactgcaatgtctcgcacgccctctccccagctttcgcctgtttcacaagcgttcgatccctccgacttgagcacttacaagttggatgtgctggttaactaccccctctcggatttggtgcatcaccttaatgccataccgcgaaacctgcaagtttccgacaggcattccgacctgaacgcagctaaaatcaacgttttacgggctctttgtgtgggattttctgacgtgcggcgcaaaaatgatactcgcactttacaacgcacgcccatgttcgcaatcggcgacgccgcatcgcgcttgagaccgtccattggattgaaacggacattccccacgggcatattctcaacaactatcataaactctcccgcagacgatgatgcatagcttttgtgagtcgacatgctttaataaaaaattatccaaatcgaacgagtctacttccctatgtcagttatccggtcaggagcattttgattttaaatatctctatcgttaatgtatcgattctggctctcaattgttgtcgtgcgtgtgcgatttgcctggccatcttttcgcatgccctagtgagtgcgtaaagcgcgctgcgtcccacctgcctaaaatcgcgccttgtcaataatctatcggcagagattactcgggacgcgctcgattcgtccgtgctggagcgatcgctatcaggaacactagattgcgactcgccatccgtgttagaatccacggacgatagagactccagcgcaaacagatatcgctctgggtcgatattggagtcctgttgcttattttgccctgcttctgcttccgtgaccacgaaccctctgtacatgttgtgatggtcgtgctttgccgttgtcgccttgcatggcgaacgtcggcacgtattaatgggtttcgactgcgaactagacggctgcgcgggtctcgacagaatgtttcccagaaccgcactactcggcgacgaaggctccgctaatataacgtccgggggcgcaaatgcgaagtggtcgtacagtccgtgctgcgccggactcccgaccgccgcctgctttttgccaccaggtgccgtcgagatatcgacggagcggtcaaccggttccaggttaagatccgcggtaataacggctggcgacgctcgttgtaacaagggagacgagtcgcggcgcacggaagcgagtccccctaaagtatcgcatcttggccttgacgcattgttaggacgaacacgggcggcgcccttgtccgagatccgtccgattgaatcaatcctcgttccggcacgcgacggcttcagcgctcttatccctattcctccgtcttcgtcgtcgggaatcagggattttgtcgaagacgcgacaacaaatggtgttgaggtcgaatcggagtcagatcgatgtggaatgtttggagttccatgctttttcctatcatcgcgtaccgagttatccgaaataactacggcaggggacttttggtcgagagcgcagccgggtgcgttacacgcggctgccgtatcggtaaattttagcctcccacgatagacaggctttggcatatcgtgcgcccgttcgctgacatcgatatgttttacggggcgccccttctgcctctcctcgatcccgactgctgcgtaggtagattgctcgttatgtgtttttttagttacgacgagtttttgagtggctggagataacagggacgggctcaatgtttcattatttgggggggcgagcttatagtgaaaggcgagtttggaagaggcgccatcggaagcatcggtgctaaccgtagaaggacactcgacattctcgggaactacccggtcgctacgatcgttcaactctttatgaaacaaaaaacccgtttcagcattgtcgtagacgtccttctctgcagccatcccatcccacatgctctctctatcccgactaaagtcattccctggtaattcttcatcttccgacgccgttccaatagatagtacatcctcgacatcgccgtctcggctcttgttgtacacggggatcggatattgtctagattcgtcggaaaaaaaattagccgcgtcctgtcggtcgagcacggcgatgtcatcatatgacgcgcccgtttccacgcgaatgcccgcatctatgtatggcagttccgagagaacagcgtcatcgctggaagttagccgtattacggggatagggtcgaataccgtcttaggccatagaactttcacgggaaccattcccgtgtccactatcactaaacacggaggagcggaagaaaggggcttggaggctatgagatgggacaagtgttccagctgttggccgaggcatgcattttcgattggattgctgtcgtctgccaacaatttccccccccaggaagtcgtgtcggatgaaacggcggcaggttcgagaaagcagccctcggagccgcttctcgagtcgaaaagacggacacacagattcagtccagagccggaggaatacgcttctggacattctgcggcgatcacgatccgtgccccgaataatgtagctgcggctgccagatccatagcgtttacttttaagactccgctagggggtgtggacgtgacggtaaatgtcatcgccactcctgtgggttcatataaattgggaccgtctgaacctttcgggatagttttgtcggcgggacgtaacacggacgatgtggtcacgtctaaagtcgaagcagcgtccccgcgggctgtgacgacgtcatcgtagcttctacagctttgctctatctccgcgggtagaagcgaggaccacatcaccgccaatgcggttggcggaatgcacatacgagccagcactgttgtcgttgtcaaaagattcgacggcacgaccgcacgaattttggcaaggcccgtactcgtagccccacctacaccttcccagggtttaagggggtctgtttcggaaaggctgccttgtttccaatcagaataccgcaaagcaaaaagggatccgcctgacgggtcccacgctccgcccgttaaactcatcggtcggcaattcgagtccgacggggcatctttggatagctgcgtagataaacagttgataaacgccgtagtggacagcgactcattgatagcgccatagagcgtcttatccataaaatcgtactggctaataagatcgagctgggaaaaggtcaagacgtgccccggcatgcacgtcataatagcaaccatcacgtcggccaactccagccgaacgggtcgtccatttgcagctatttttttaagcccctttttgtcggcggcaggggcgacttgccccggaagaaaaaaaatatcagacaagctagcacccgttttacgcgtgagcgtaatggccattaatgcgcaataaatggacccgatcgcttttactgtgccatccgccagccaatcgtagttttgcgtacgtacatacttggtgaaggcgcggaaattatccgccgcggcttgaacgaaacccagcctcaaggccatgatgtcgcctagcatgcccgcggcaactaccatatctctagttgacataacttttgaagggatcgcgggcctcaggcttaggccggagggctcgcacaaacacgcggccattttttcaccaacagttcgatagcagacagaatatctcaggggcgcgtcggaggcgtctaaatatgtatggatgcctgggatatctatttcagaaaacgcctcctgcagcgtgacaacaactgatggtctgatccaagcagctactcggtgtttaagatatcgatccacgaaccccgcggccggtctgttgttcgcgtcagcattcaatcctgtatcagaggggaggagcgatggacacccggcaactcccggcaaaatggcggaatatgcagcatacagcgccaatctcagctttacaagccgcgagtatcgagttacgtgccgaacgtaccacttggggagccgtttagagagaatatcgaattgcgaggctattgtactgagatcgtttaagacaaaggttggcgggatctttgcacacagagtgtccatctgtttttgaatcgattccgtttctttgagggccgccagaaaagcatccatgactccggctctgtctctgtatttcgcatcgataagtccgatgattttagccggcagcctagcatactctgcgttatcgcgcaaagcgttgatcgtattggaagagactttagcgcgagcagcactatctcgggcggcggcaaacccctctgagctcttgtccatcctgtccttatcgtgcataaacgtggaccatgtgtcatcccaagcgacttcggcaagcgctagttcggattttaactcgtccaatcggctcgctaagtccgcgagagcatcgatccgctccgcgtatatagtcatcggaccgctttcgtcgatccgggaagttagctcgtgcgaatctatgacagatcgggcgtgttttagccactctaccgtttgggtatccaattctttagtttcttcgactttactcaaaagtattgccgcttgagtgactatgtcgttcgcagtttcagccttttcaatagctttcgctatatgcggaggcatcgcgaccagccgcagcaggttttttaaattggccaattgctccgccgtctctctgtctgcggcataagaaacttcggccaaactcttcagaataacttcagctctcgatttcgcgccctcaatagctgtcgttacccgcagctttattgaggagacggcttctatatcgcgttggagagtatgagcgctatactctgcataggctgtcccgttgaacgccgtaatgtcttccttttccaaatcgttggttattgtcagtatggcgttcgccgaaggaatcacgatagagaccccatattcaagagcgcgacgcgccccctcagggctatacattctagccagattctccaatgcctctctaatttctatatctaccctccccgctgcgtgaagagcctctaccctcatttgttcatgccgagctaaaaagcccgtaaattcctcatgcccgttacgataaaaatccacgtatttggccaacgttgggaccgctcttacgtctggttcaatttcgcccaataacgtgtaatagtccaagttcccgccgcgggcatccgcgtgccttaatatagcgagtactatcttgattaactgtagcaaggcgtcgcagctaactccgaaaagttttgtgtaataaggagccgccgctataaacgcgtctagccaggtcatatttttcaaaaatgctataggaggcagaattccatgaattctattcggggtggaaaacgggttgaacttcaatacagtttctatcgcatcgtgaatcgcacgaccatgcgacataacaattttctcggctctggctctgaaacggatagtgtcgtagccggccaccacggcccttttctccaaatcactcatctccatagcatcaaattcggatttcagctcggcattggatagtagggaatgaatcgaggaaacccaaacgtcttcgctatgcgatctctgggcacttatcagatttctctcgtaggttgtaacggccgcctccaattctacggtccgctgatttacaagccctaccgattttgccaggtcggcaattttacgttggatgtgggggtccgtaacatgcgcgtgactctcgagagctgcgatggctgtattggcgtctctcgcgctctgcagcgcgtgagctatttcagttctggcgctcattataacactggcgtcgctatcagcggctgctgttttgggatctgaagttttgaccttggttattgacgcgatcacgctattgagtgccgcgcgcactgcccgatgtagaccatctaaacggtccccgtgctgcgccacgcccgcggccacctcagcgtcggataacagcaccgttaagaacgaaaacgcgtcatcctggcctgcgggtagatcggccattattcccgtagagggagtgtctgcagtcgccctgtttacatcggatacggcgttctgcagcgccgtaacagccgccgtagttttttcgaccgacatcggttcgaggcgcgcagcggcgactgctgcagaaagcgtatcggcatgtttcccgaaaaaaaccgacgcggccggataacccccaattggacccaatattacgcgtatggccagagagaaaggaatgccgaggccagataactctgcggcagtgctcgtactggggtgtgacaaaattgtcctatactgagagaacaacagccacaaatccgttcgcaaagtcccaataacatcgggtggtgcgagagctagaaaggtctctagcggccccgtatctccagggatggattgcgttatggttttgactgtcgagtccaatgcgcgcaacccagcaaacctttgtagaggacgcagcatcagcttaatcgaagaatataaagttctgatctcctcgtaacgatattgaagtgccgcaattaaggtttcggcatccagccgcctacgggcgatagccgcgcggtcatccgaacttagcaaatttgcaaatttgtcgccccctaaagcatttgacaattttactaactcaaccacatccttcataacttcctccagtttttgaagatcggccgttgtctccaaatcagtgtatgacgcaactctagcttccaactcatgtaagcggtccaaatccgccagggctgtttcacggcgggcggcgttgttgttaacggcatcgacttctttgatcagtgtttcaaactcttgtcgactaatccacccgcccgcttgaacggctgccattgccgttttccataccgccagattttctggattttctaaattagagtcattttccagcagatccccgagcaatttagattccggtgcagttgttacgggcggcggggcctgcgcgccactacgcgccgctactagggcaataacatcatcgagcacagataatgatgcgaacagcctggccattttttcatgttgctcgacaacgaccattttaaatctagatgtgctagccacgttggctcgaagcgcattcgcgctatagagagcccccttcaagtaatattcgtgtagtgcgttgccgactgcatcaacggctgccctctcaatagcagtcaagcgctgtgtaacgacagatggggagactttagctatgctctcgtcgtcgcgcgatccagaagtacccccagatcctcccattataaatgcatcaaatgaggcgtgcatcaatcgaacgccggcgtcgagggcctccaattcagctagtatgagttccgccttcctcctggcaacagtttccctatcacgtatgaacctgcacagcgatgcgactctgtcggtcaagctctgttcggcatgcaaagacgtcttctctgagtatatctttcctggattactattaaacgcgcttactaacgatgtcgccatcctttcgtagattctatctgcatccgcagtgctcgcctctctctctatagagtccaaagttttgtgaagggcatctgtgagctcctccacttccagagccactaataccagcttgcttagggccaatttgcctatcttggaattttcagaaagtacagattctatgaggtctgcagattctccggctcgcgaaaccgccattcccgtagaatcaatgaacgcgctaaagtgggcgggcctcgtaaatgctttaaataatgatgccatctcggcttctacgacagatcctatttccgttgtggttcgagcgccgttttcgataacgtagttgaacaatctggtaaaagtatccagcccacatatatccagaagtccgtcatagtcacccgaccgtgacaagtggatggtcattcccatacttaaagctatagattgctctaaatcatcgatgttagcattgatgtcgctcagaatagagctagggacgtgttcgcttgtccatagcccgtctcgtagcgactcgtccccttcccccgctaccgtgtgaggattaaaaggtggccggtctcgcaacgattggccgtgcacgaagtgctcagcacgcgcctgagaacttataaactcattgaaggagacattgtccggccgggtagcttcttcttgaccaggtatattatgtgtcgtgctcgatccactatctgcttgttcagacaaacttatcgatggagccaccggattgtccgtataggtcaaacatcgtttagttttccgggacggttttctgctcgaagattgaccttggccatcgacggataagttctctgaacttgacggaggagtccatacagggcgcctcctcttatgtctctcaaaagactgtttgggcggggagctagatttcgtgtcagtttcaagccgaactacattttcccgcgttttgggcaaatcaggccttgttagcaccgacagatcatcgccgatgtccgggaatgcagtggtccacgcatttacgatggactcatgattggttatatcacatatggcatcaactggagcctcctcgggaggcaggacgtatgcgtcctcctccgcatagcccatttcccgcctaacatccacatcccctgcagcgacgggagaacgatcacttctggaatcgacagcgactttgatgtcctcgctacgtgacgtggaggttccaatgatgatcctagttgttgtaggctgtggcctgtaagggggatcgagattggccagcactactttaatgttctcttcctcgttaaccctgcctagatccaaaacgatgtccgctgtaccgtacagccgtgatacggctgatattatttcttcctttggcggtgtactggagatcatagatacaaagtaaacaaaggtcgcggaccactctggcgccgtcgagggatccgcataggacgtgagatattgataaaaataaccctcgcttactcgaacgatacacgcttggcctatgtggccatgaccgtgtggatcgaaaatgtagattccgttatcggatctgtacacccctattcctatgacgccgatgacgatcaggcaataaatatcacctcgtttctgcttccatactttttctatgaatgtccgcgcagatatttgggtttctaagatagtggaggtgttttcatctacgtagaagtccaattctccataggagctcgaaaacgcaacacacaagttgccgtcgggctcatttgataagatcctgtttggtaaatcgtgagggacgcaagtcgtataccttccatcgcgagaggtttctattgtccattcctttccctgcaataacagtctatctatggcctcggtcgacaataccgcatccaacccatacgcaaaaactacgcgcagaaacgccaatgacgaccgcaagcatgaaaccgatgaccccggactcaagtccggggcaaattgattcctgttgccaacggcaactagtgtaaagtcggtggcatcaaccaccattcttgcccattcatctaggattacctccgaatccatgtttgttcccgaacgcatggcgcggttttgcatgttcgagacggagctgtccctcgaattatccgatgtttccaagcgccgcgtcgagggactcggttgtaaccgcgtagatttcttggatgggcgtgtagtgctccctctactctcactagcagccatatagacgatggggcggaatggcgcgtcttttcagattgcgctttgtcattgagcgagttagacattaaaagttgattaactccaaaattgtgatcaatcagttgcggccgcgtaagtggcgtggctgcaacatccaagtcggcacgaacgaacgatacgccaggccgtaaaacgatagacgtgtgcgtcacgcattgcgatctctcgcctgcctttcgttattaaacaccgtatcgacaatgtcgaccaaaccgtctacagttactctcggttttatgaggaagtccttcgcaaaattggcaaggtccacatcatcgtgtgccaccgtatccaaatccaatgtatcaaaattgagttcgtcacgatgagttaaattgtgcctcgatgtcagttcgactactagggcggggctatcgtcggttactacgggcagacggcccagcagggtcgctacagctgcgtcgatttcgtcgttcgtgacacggtcttccatatcacgcggaacctcgatccgatcagctattttttgccatactactcccacattctctatagcactggccaagtcctgcgaacttctgtcacgaaacgtagaatttatttccgacaacgtttgccatttgtccagcagccacacgatatcgccggtcccgggcggcgtggaacacgatgtcaaggctctgacgtgcaggtccagcgaattctgcaggcgagccaatctggcatagtcggttccgagggtagaaaaatagcttgctgcctttacgctaaataaaattgcgcgctccattaaattatcgcatgtatgaacttgtttcccagtttcttctattaaagtccgcaacaccattgatttgagtcttacattcgccattacatcacccgaggagtcgtagaattccctgagagccgacagcacatcaacgattttccatgtgccaaaattggcacgcggctcgccacggcggtaaaccgttacagtacctcctgctgtaccagctgcgaatttacacgcaaagaaatgcttaaatatgtacgcaaatttaaccaactgcctggatcgctccgctaaatatgccgcacacttcaacgttctatccgctaagtaattgaattgaagtcctagggccgttccatgcatactaatcaaaagcaaactattcgatatctctggacgggggggcataatcggtctggtctctggcggtaccatctgcacggccgcatagaccacgtcgtacaattcgcccatcagcatttccagattatacgcatcgtccgtggtaggcttggccgtcagatctctagcaaacggagcgagtgaggaaattagagcattgagcttgtttctatgattcacgaaactgccaatgtacggcgcgccgtaatccctggcccaagtcaaaatttcgataacagtgtttatcgggcgttcagaaaagacagatgtcgtgatagccgacaatgcgtccacgcaaacggtagctagaatatatcttagaaaatggggagttgtgctttcaggtgtgatgggcatggattcaggatagcgaattgtcatggccagacgaatcatacggctctccaggtctgggtccactgcatttggtccagagatactctctaaatccgaatggtccacactagctagatgttccgacggttcacctccaattaactcttccggtggcacgattccccatatatgctcggctctggagtcgaaccatagcatgagtgactcctttgcaaattgtattgctcgattggcagtcccggccccgctctggcggattgcgctatccatttccgcggcgaggatcgctcgtgcagactttacatagtcctcgtggggatttggcggtatacatcgccctaatatctgagctatgattgcgctatctaacccaagtacttttatgaaatctgaatcggcgtccggaggaaggccattgtccatataattggttaagtaagtcatgccgggaccataactttccatgagtccgaaaacgatgtttccgatgacagctatgcatccgataacctgttgtacgtcgtcaaatgtgtcgagttcattaacagtaccacgagtttttcccaaatttgcctttagcgccgattcataaacccggcatgcctgtctcacaaaacctctttctataagcgcttccaataactgtctcggcgacgaactgtgttgtacagccccccatgcccgcctagccgattcggagagtttcgctttagcagcatcgagagcgcccccgccgtcatttaagtcgccatcggtaataagccggaccacggcagacatatggatcgctaaggcatcttctgttaatgcgtgatcagctaatataatgtctggtccgttccgcaacttttccgctaccatacccggctgaactgcatatacatacgggtctccgtatgctatggcggcagatgctctaacatcatatgctgttcttttcatattgtttgcctctacggccgagataagttcgcgcgagcccaatgcgctggcatcttctgcgaatagatcctttaactgagaaggatggggcgatcgcggacttttaaaatattgatcgacaagggccagcgtaaatagtattcgagtgagtggcgtaaaggccctatttgttgtacatcgagacataataacaaacggggtgatccacccgacggctatagaaattaatcgaattccttcctgaacaaacgggaaatcgtaaataagtttaaagcgcgtctgcgtcaaggaagctggtagttccaaagcattaggagcaggttgacgtccggataacaacccttcggaagtataatcaaacgcgtccgtggcgatctcttcaaaaattgtcagccactcacttattaggggccacaaaacactcggtccaaaaggacatgatctgcgcagaccgtttcgggtaagccacgcaatggcttcttctcccgtcatttcggccgccaatctacgcaacctacgagaatcgtctttccaggacattttatcccaccttacggaggtacgccacaagatgaatccgacaaaattttgggccagcattgccgcttctgggcttcctgtttgtttgtagacctcgagcacagccgcgaatgcatcgcgccacgtcgattccacttgctgaatactcattgtttctagagcctggaaaaatgatccgatagcagttcttgcttccgcagctgtagcatttccccacggttccagtggcgccgttccagccgataaagaccttagtgtatccagtaaagttttcaacgggaatctcgcttcgccctgggtttcagacatggcgcgccaataggtagggatggatctacgtatgtcaatggaggccgtataaagcttcaataataatacgttccctaaaatgctgtgctccgcaccgcagaaaaatatcgtgtgatccgcagttacaccataccgtactttatcatctccatgacgcatcgagatcccgtataggccggcccacgtaagaggcacacgcgctacataactttgttgcgtttaactacaccgccagtcctgtattgcagtatactaggtgacatacagcgatttttatgtgcagtagtgcacacgcagttgtcgcaaaacgggcttgcaaacgatcatcgccaatacaggatctctttataactggttgttgatagtggacgtcatgaaaaccacttttcgaacaagcgacgtgcaggcatccaacacgcagtcaaatgcctcggacaggctgcatgacatcttacggagcatcaataactcaatgcactccggcattgttcggcgcatcaacataggctatccgcatgcgggcaacaggcgcgggacgttgaccgccggattggaactgttgagcaatacgatcacaacgacccctcccggggcaaacatacaccgctccattgcaaattcggcaggcgaagctacggcaacgatcatacaatctttacgaacatattccggaagtggagatctgaacacgaatggtgataataacgtcctttcccgacagatcagcctgacagatttctgtttccccgatgcggagatgccaggactaattgtcttatctatgcgacatccactggatataaacagcgaagcattatacagcacacctgccggacgggacccacgggcattggagtcagcgtggtatgaattatctgaactggccgcggtatcggtaaacagattagacggaagtggtgtccggccgtccctattatcgctctcatttcttattgcttcccgcgcgggagactatgcggataaatgtggtgctgaggctgtaagagctcacgtgattagcaattacggccgccggcggatagaggacaggctcgacaggttcggaagctgccaagcagcaatgttgagatgtcacgtgttcccacaccgacatatgcaagtattagggggaatggtgtcgtggatcgcacagcgcgaaatcgccagtataaccgccgtggtcaagggctctcaagagagcgccaggacagaacagaccaacaatccaagatcgtcggtatacgttcccgcatgcgcctatctcgatttagataaagagattcacatgctccatgatgacagagcttcttcgctactatacctcgttttcgtttatgcacaacacctcggacgcgagagcatccgtgtatatctcatgcggagtcgtttaggggaatcggtgttcagagaaggcctcggttacctgtactccgggctaagagccggtaacgctattaacggtctggccggtataatagcgccacatggagtagacgcgaatacggaatttccattatcaaaagctttcgaggtacacaaacacgcctgtcgaaacaccggaatcggacctcgagactccgagaaagtggactggcgtttagatctccgaggccgccctacaaagaattcctgcatgtacgcagcatactgtcgcgtagggcacttgaacgagtattcgatgccggcgaagaagtctgaacgttgtggcgggtctgtggaggtccctgttgtatgggtgccgggagtagtgtgggatatcggagaatggaccgagtgttatcagtagagagttggctacaccgagatccggcatcataccttacgtgaactgcttacgtttggggatgtttttgcgtcggtgtttggggaggagtcaatcttataaaaagcctatttgtggtacgcttcggtctcgcgctcactgagcaacccgtattttatccagtctgaaatcagaatctaaaatgcagcgatccgatgaaaacgaatccctcgaagcgaatagaaatttggacaccgcctcgcgtaactgtactgatgtgcaggtagccttgataatggcaacgaaattgcatcgcatccagcagcaacttgcgagcatgggatatttatctggctacgattccgtgcccgatattactacacccgtgaaagttctgcgcgagcgcattacccatctagtaaatacattgaaacccgtttgccgtttcgatgagcgcgtgtactacgcctgcggggagctggtgcatttacggatcaaatcacaggaagctacttttgatgcgtggttgatgtcgaaaaaattaagcctgaaaggcgagatcgtagataacatacagcgccacagaggtcacgtagagacggatatgctgcgcttttacggagtaacctatccctggctgaaacgactgggtttacagtcggcgttgaaatacgaagaatatctgactgagttggaagacggcaaaaaagaatctctttgccagttttttgttcggctggccgcggcggcagcaaccgaagcgtcaaacaaaaaagctttcatgtcggctttgggtaccgaagtgtcgacctgggaaacggctttcacggctttttttttcgctctcgctcgtcagatatttgtcccatcgactccctgtatgctttttttggggcgcgaaggaacctcaaccgcgagctgttatctcatggaccccagaactataaatacacacgatacccttaaagcgatcgccgacgatatagttccccatctcctagcgagaggagggatagggatatcgttgcagcatttaaaccaaaaaacaggccttatgcctgtgatgaaagtattggattccttagtgatggccgcgaatgcgggggagcgtcgacccacgggggtatgcgtttatctcgaaccgtggcacgcggacatcatgtctgcattaaatatgcgcggcatgatggcgacggaagagtcccgtaggtgcgataacgtatttatcgccctttggacttgcgatttactgtttaagcgctacgagagacacgcaaacggggagaaaaatgtgacgtggaccttattcgattcccgcgcgtcgatattggccacgcttcacggatcggaattcgaaaaggagtataaccgtttagaagcggaaggtttaggcgtagctagcctccctgtaagggatttgatgttcgcaataatcaaaagtgcggcgtccaccggtagcccctttattctctttaaagacgcgtgcaacaagcactacattacagatactcaaggagacgccattgcaggctctaatctgtgtaccgaaatcattcaaaaaaccgacggaaatacaaacggggtgtgcagcttagtaagcgtcaacctcgcccgatgtgttttcgacgagaacggagagaaaaaatttgatttttccgcccttagacgcgccgtgcggctggctacggtgttcgttaactcgataatgtctagcagcgatgttccgactgcgaaatctcgttccggtaaagatcgacacagatccatgggcataggcgttcaggggcttcatacagctctgttgtcaatgggtctcgatttgagcgatgaacgcgtcaagcccctcaacaagcagatttttgaattgatgttgttagaggccatgacggtcagttgtgaattttgcgaaggcgggttgcccgccttcgccgacttctccaacagctattactcacgggggcgcctgcattttgatggctgggcaaacgtaggcttaagtatgcccgaagagtggaatgcgctgcgggagagaatacaggcgtccgggttatacaatgcccagttcgtagcgttgatgccgacagccgcatccgcacaagtaaccgaagtgagtgagagttttttgcccgtgttcagcaacatgtttaacaaagtgacgacggcgggggaactactgcggcccaataatcaattaatgggagagttgagggagatctatgcggataatgaggatcggcgattgaaagccatagcagcgttggagtgcgcgaactggtgcgtggagaccgctctgggaaataagcccgaatgctctcaattacttaaatacaaaacggcgttcgagtacgaccaatccctcctaatagatttgtgtgccgatagggcgccttttgtggatcaaagccagtcgatgactctgtttgtgacggaagcggctgacggaacgctgctggcgtctcacgtcatgaacctactcttacgcgcctataaagccggcctgaaaacaggaatgtattactgcaagatacgcaaggcgactaatgccggagtattcagcggtaacggcgaattgacctgctcgtcctgcatactataatctccaagcatcccggcattttgaccatggccacgcaagcacgcgggaacgaatttgtcagcggccaaaccgcacctctgcacaaaaacccgtgtcccgaaaacgcggcggccgtcctaaagatggaaggtatcgagatcgaaccttcgactagttccgctagagataattacaaagtgtcacggtacttctacgtccccgaatgcccagatatagggcacctccgagctttgagtattatgaaccgatggacggagaccgaatttgtcgtcgccgaggatctcggggacgtcgccaagcttagcgaagaagaaaaaaatttctaccgattcctctttacgtttctctctgctgcagacgatttggttaaccttaatatagacaatctgttaggtttattcgaacaaaaggatattcaccactattacttcgagcaggaatgtatagaagctgtccactctcgggcctatagcattattcagctgatgttattcgacaacgactcctcggcgcgcgcaaaatatgttcagtctgcgttagagtcccccgtcatccaatctaaattggaatggttagaccgacgtatactagagtgcacgtctataccagaaaaatatatccttatgattttaacagaaggcattttcttttcagcatccttcgcggctatcgcttatttgcgcacgaataacctctttgtcgttacatgccagattaacaacctgatcagcagagacgaagcgatacacgtagaggcgtcgtgctgcattttcaagaattatatcgctggcaacaagccatccaccgctcgcatccaagccttatttagcgaagccgtcgacttggaatgtgcatttctccgcgcagccgcaccacgcgactctcgcttattggatattggctcaatctgtagctatgttcgttacagcgccgacagattattgagaatgttggacgtgccaccgatttacggcgaacccagccccgctgccgactttccgctatctctaatgtccgcttcaaataatacaaatttcttcgaaagaagaagcaccgcgtactccgggagtgtatcgaacgatctttaattagcctgtgtgcaactgtactttctacccctacccacaagaattaataaatgaattcaaattatcgcttttcgcaccgtgtagtttgtgatgcatcccttccccagtaccttatcagcacggagtcgaaaggccgtacctccgggatacaccttagaaatgcggttgaaataactgaagcttcggcctcattgggtatactgcgaaacaccaattcttcaaccgctacatcgtcacgtatatcctgcattatggggaatcgttttaaaatactaattctgggcgttctgcgctcgggcattatagtcgcaatgacgtgctttatgaacttgtattcgagaacttcgcatctcgtttttggggggtgcaaagatcttaacaagctgtaattggacgcgagatccctgttcgcatcgggcatatcagccggtctctcgtaatgatggccgcccgtgatctcaggattgcaacaattcatcaacgacgaccggccacgctcgttatcgctcgctttaccgcagatagtgcccgaaccctgcttcaatgtccctagatctattatctcttgcatggatttcagtgtgtgttcgcaatggaggtctgtttgacaccgaacgaagttagacaaaaacgtgaaatagtccatttttaacgccgccaaaacatctctgcagtagatagtcggcggaaatattctagtaaggtcgatgattatatcacatcccatcaatagcatgtctgtatctgaagataacacatacgcaaccgttttggtgtgaaagaggttagcacagatatcgtccgcttccatcatggccacatcgacataagggtatcccatatagcgaatggtatccatgcagagcctatgtagaattttgggcgtatcagacttatcgctccatctgcgtggtcttttccgcttccgcgttcttttgttccgcgcttctccggtatccgcattctcgcattcgtcgcgcgaacgtacttgcagcctcccagaacctcctcccctcgcgatgcgagtagctgctagcgcctttgctccataaagcgttttcccatacttcgaaaacccccggtccgatacaaacaccggataatacgaccgttggtgtaacaaacgcagcagacagtataagcaccgcagcgtggcgaccgagttgtcgactccgtcgaccttaccagggtaaattttttccagcagtccatacataacattccataaatccacggcaatgggcgtcatagccccgccggatatcgaacccgaaatgtgacttctcactaatccgttcgcataggcgaagtgcatgcaaccgtacacgcccatggcaactttcggagtcgcagtgtaagagacacggggtaatacgaattttgaattttgggagtatctgtcaagtatattcaactcttgaataaccacgaccaggcgtagctatccaaatgccgaaacgttaagccgctccataaaaccttgattccactattcaattgtgcaatagttggattagggcaggtattcggctctatctgttcaccgtatacacgctataccgtcctttaaattagacaaggtgcgcgtctctaaacctataattcccggtagcggtataagcgacacttattacatgcctatccaccacgtgatgcaacccacacgattcacgttgaagacatgtgacatttgctgtaaatatacgcaggtaacaatgtgtgcggcgaattagacttacagccaatagtaagcgcgacataacactaaatgggcggcgcgacattcgagtgcctataggagaccgatatacgtaaccacgcgtggtgcgattgcgacccaggctccttcgatataagctttccccctcacatccggagccatccgttagattgactctgcctcagcctatacaacgcgccaaagaacagtgtgctacggacagaagtgacgccgacttgagttcacggcatcgagaccccagaaccggtctcggcgatggcgcgaataactatgagcgatgaacacatcatagacgatgcaggggccacttctaacgattcgcccaattcctggaaagtcgtcttggccggagagaaatttagaacggtatcggctgcagtacgcgcaatagtagattctgtgaagaatcccctaatcatattcagcgacgacggattaatgatacagggcacgatttgcggtcagcaaacattcgttcctatcgagtgcgccgcctttagtgaatttgaatggcgcgggtccgcggccatattcctggcgctaacagattcgaggcgtactttattagacgcgtttaaatgcgacaagaaaaaagcaatcgaggtctcctttacgttccgaggggaaccgccgtcgcgacatctaacccagacagtcacgtatgtaactgataacggatcgttctcgagtgctatcatcaagtatgaactgtggtgcgcctcagttttattcccgcaaaaaattcccgatgttacgttctcagtaaacaaacagcaattaaacaagattttggctatagccgccaagagacggcacgagcaactaacatttgcgttgaaagcagaaggggggttttatgccggaactgtgtgcgatgttataagtttcgatgtagacgggagcgcaatgactcagtatccgtataatgccacgactgcggtctcgtctgccctcgtcttagcatgcgggaagaaaagagccgcccgtaatgcacccgtgactgcatatgggagcggaaaacctttctgcctcgcactggaagacacgaccgcgttccgaaacgtcgtacagaaaattaaaaccggctcggcaggggcagatttgggattttatacggcgtgcaatccaccgatgctatgcgtgcgtccgcacgcgttcggcagcctgaccgcttttctattttgcaactcggattgcatgtctatatacgaattggaggaagcgagtgtagcggtcggcgcagtaacatcgaaacgcataaacgaatattttcccagagtatcgaccatcgattcccggaaaaggcgcccgtcttcggtcctctcggagggggatgggaaactccttaaacccgacggccaataggtctcgtgtccgcgcgcggaccacagtcatgacgcggggaggtcaaactgatataagatgtgataagactgcttagatttcattcgacctggttattcggacatacatggagcccgtcgacaacgcgtctccgttacctccgactggcgcgggacactgtcttcataggattgtttgcatcgaccctccatgtacagcaaccattggcagcgggaggagcggcaataggtgcataaaatgtattatggttacgacgggctccctgttatcgatggccgcacacttgaccgtcaccgtattttgcgtttccgtgattccgtgtatagatcgaaccgcagcctatccacgctgcactatgggcgccatcttcgcattcctattcttttttaacatgcggcttactgcacgatcatcggaaatagtgctgctcattggcagaccgacacaatttttatgcgctctgacagcatcaatcgccgacacggtcgccaaacatctagcggctacccataaggattacctgacgacattgcgagcaatagaagtaatgtctctgttgacttttgtcatgctcggagctctgatcgcatcttatcattacgtctgcatagcaacgtctggagacgtgacgtggaagaccgggtttttagttgtggcggcagggacgattgccggcatcacggctccgtatggagacatttctcctctagccggctttctttcggcgtatacggcgttagctattcacgtggtcagagacgccagtcggtctctaatgaacacgtgctactaccgtgcacgtcgggaaattactgtgaacggtgcatatcgcctcggtcgcgcgcgtctcccgcccagcacggacgccgaggcgacgcgcgaagaagacgtatccagttacgatacgctgggggggaatattcctacgataattctgagcctcatagcggtcatctcgattccagccatagccagctttcaaaagtacatgtcgaacgcaactaagcaccagtcaacattgactgacacgttacgcagtatatgcggtttcttggtgggtacaagtgtcgcgatattccttccgtcgcgctaccacgaggttctgttccgtccaattcttgtattactgttaatattcggggcaatggctactaccttagccggcttcggtttacttctcgggccgacattgttttccgcgacagccgcggttctgtgctgctacacttgtataaatgtacgcaacgcgaatagcggaataaagcaattggcggccgccgcagctggtaaatgcatattaggaactgccatctcgagcatgttggtttgcgtgttaatacaatattcctgatcgcggagcgattaatttttatatcatgtgctcatagcgttctttcgaactgcgaataaaactttcgtggctactaaaggggcctatcgtgggtttatgcgctgtcgaaaacatgaaagggccgatttaaagctaagttgcgcaggcagaggccactccatatacgctctcggagacgcggctcgcacgccagctgaaatattttccccatgcacgcgtcacgcgcgttgcgagctttggggtggacgagactcttatttgtcgttttattttcgggccgcgtcctaagcgctagcattaaccccgatctagctacacccccggtcattgctttcaacccgtcaagtattccggccgatgatgggcctttggccaaagttcctgcatccccgccggcaggggagaaagaggagagccacaagaatgcaagcgacgcgcgtaggatgcctagtatagtttgcgataaagaagaagttttcgttttcctgaacaagaccgggcgtttcgtgtgcactcttaagatcgcccctccctccgacaacgaatggtcgaactttgctctggaccttattttcaatccgatcgaataccatgctaatgagaagaacgtggaagcagcgcgtattgctggcctctatggggtgcccggatcagattacgcctacccgcgtccttctgaattaatctcttctattcggcgagacccccaagggaccttttggacaagcccatcggcacatggagacaagtacttcatatggctaaacaaaacgacgaatacgatgggcgtggaaattaggaacgtcgactacgcagacaacggttacatccaagttgccatgcgggatcctttcaatcggcctttactagataagcacgtgtacatccgcgtgtgtcaacgacccgcctcggtcgacgttctagccccccccgtcctcagtggcgataagtacaaggcttcatgcatcgttaggcatttttatccaccgggctccgtctatgtgttctggaggcaagatgggaatatcgttacaccacgtaaggacacggacggaagtttttggtggtttgaatcagcccggggagccaccctggtatctacgataacgctgggcaactcggccatcgaccctcctcccaagatttcatgtctggtagcctggaagcagggaaatatgatgagtactacgaacgccactgcaatcccgaccgtatatcatcatccccggatatccctggctttcaaagatgggtatgcaatatgtactacgcaatgtgtgccgttcggaattaccatacgatggttagtacacgatgaacccaaacctaatacaacttatgatactgtggttacaggtctttgcaggaccctcaagcggcatagaaatatcatcagccgaatattactccaagatgactggcagaaaacaaagtatacatgtcgtctcatcggctatcctttcgacgaagacaaatttcaagctttcgattacttcgacgcgacgccatcgacgagggggtcccccatggttctcgcgatagcggctgttgtgggactagctttgattttgggaatgggtacactcctgacggctctgtgtttctacgcctccgggaaaaaatacatattactttcgtccgtctagtttgcggtgacattgatctggctcattatatgccccgagctcttgtaacatcgcggacgcgatttccgtagtaggcacatctcaaatgcaaaagcggcatgtcaaccgtataggtacatccggccctgcttacagtcggtagggcatatatccaccggaaaacttcagctttagactcctcaggtgatgaggaatagtatgtaaccctctagcagtacggtatttctaaaaaaaggtagatccttttccacacggcacagactaaataacgtacactacacaggttctctcgaacttcgtttggaccggaattattccctcggcagcgcctaaaaagcaaacctctagagtagataagtgtcagtgaacctaggccttctttgttccacggctggaaagctaagggacgaggtacacgcgaccccagccacgcacgaacagagtttaacggaagcgtcgtttgcgggataaggttgtcggaccccgcgggtccgttgaaaagtggctgcgcgcctaccgacgaatacgtcggtaacaattttagaaatcgaatatgactgcgagtaccgtacaatcgcgaaatacggtctctatatagctactcggtccttaaatatgtaagtatgatgtcccctactcccgaagacgaccgcgacttggtcgcagtacgtgggctgctccggatgatggacgagaccacatctgagcgacacaaacgttcgcgttcaggatgcccccggttgttatgcggttgtacgatcgggatcgctcttactgtgttcgtcatcacagctacggtcgtgctagcttcgctgtttgcattctcttacatgtccctggagtccggtacatgtcctcacgaatggatcggtttaggctatagttgtatgcgcgcgatggggagcaacgctaccgagctagaagccctagatacgtgctcccgacataacagcaagcttgtcgactttactcatgcgaaaattctaatcgaagctatcgcgccgttcgcctccacggacgccaatagcagcaacgtcttccgactacgcgatagtagaacaacgtgcgtacgccccactgccgcaggaccggtggccgtcgactgcccgaggacctgtaccgccatatgccagcggccgcgcccattgagtatcgtcgcttcgataatcagggacgcccgtacttctcttcgtctagaacgtcgcgaatattacgaagtttatacggccattctctcaaatggcagcgtgaaataaacgcgagagaccgagcattagagtagcacttatttattctatcgcagagaaacaccgcgcgcgttcaaaaaaaacacaggcggggtacgataaatttacgcggccgcgctatgtttactttatacatcagaggtcatcgtcaacctgcgcaaaatttccgttaccgtaaccgtgccgccacgatgcttgcgcacggcttttgggcgtggaccggtcggtgcctccaaaaggcgttcggggggcgtttcggggaccgtactgggagatccgacagccacggcgttgcacatatctgccggaatcgccaatcccgtcgtagaagcacaaccattcctttcaatcgaaaaagtggcagggagggttgcggctcggtccgatgcgggcgaaggctccgcatctgtgcgggtcccatttgacgtagatgccgtagtcggtgtcggggagcggagataagttagcgagcactgagcgggaggcggggagtcttgagtgaagtgcatagtgaagatggactgtccattagaggcaggcgcttcactggtctcgcccccgtcctctacccacgcacgcttcgattgctggggcgagtcttgcaagcatctaacgactgagtcacctcccttagccgcgggttggtaggtgaccgtcgacttaactcgtgcgtgtttgaaccagagcgccaccgtggattccgtgtcagcccacgtgcacgagttcatggtcggaaatagctcccccaggaagcactggaaccgtttctgttgccggagagcacgtctcaatgttgagttagccatgccgccctgcagccataccgcatacccgttaaagaccatgttgaggatatattgacagcggtaattcaaaagaccaaccaacgccacaatagcgactacaggccgcgatacttcactttctgggctgcttcgccacgcgcagcacgtccacaaagcgcccatgtgaacaagaggggctaaaacggttccgataaaatggcataacatcgtagtgtcggcccagctttccgatggtagggaactcacggcttcggcaagggccaaaaatacggtatcaaagtcgctcggggcccgagggccgaagacgttagggcacgcgcgcagatctaacacgtccattagccacaccgcccacgtatacaacgtccttacataactcagcaatagttgcaagcgtatcgacgtatcggcactaggcgccgttacatcatcgggtctcatgtagtaggcgtatttttgaataagctctgtcccgtcccgaatctctcgccaacatctgagatacagtgcattatctttcgcgagttggaacggtttcttgaccaaggcgttacgattaatgatagggtaaaagagcaatgctgcttcacgtctagtcggatcgcaggtctcgggcgaaccggcacggcatccatcgcgtctcatctctaaataattcatgtaagaggcctgataacacctcttgaccgacgcacgagtcagcttcttttttttcatacggcgcgcaatgcgcgcgcggtagggcctcgtatactcttccgaggcatcccctaacgcgaggtagacgacgatacattccggaactttgttagaaggagcgtcgcgcaacagcgtttgtcgcaaagcagagagaaatcctgaggggagcacttctacgagcgcgtcttcttgagctcggatacccgaaagagatgtacccgttgtttccgatagctgacacgggtactcctggacgcgcgtcggcgaacctcgtgaccgggaatttaacgccaacgaatccgtctccggctcgggagaagttggcgtaaacaactccggcgacatgctagcgcaagcatatcggtccatcggaatctatacagattaggcgcagtacggaaaggccgacttttgggacgcgaagtggccagaagcatcgctttccttagcacaactattcttaaatgcgatgcttactcagggcggattgatagtcccgcccatacggcgcgtcaccacgatctgcacgccgctccgtgcgctttttttttaccggtccgtttttttgaagatcgcctccttcgcatcttctaacacatcctgcagcgaggctagcgtgccgagaaggttatacccgctcggaggcggtactagctttagagcttccaactctccattcttctcctctccacgaatcgctgtcgcaatgccgtcgggcgggtctcctcgctcaaattccaattctaaatactccatagcgtcgtcgcggtcggctatatattcatctacgctaacaggtcgatacaagcctttacatacgtagcacaggtggcggtatagcttaaacgtttccgaccaaacgtctacagcgaggtcgtggtacatggcggcgatcgtgaggtgcgcgacgccgatattcaaatgccctagcagacgttgcagaacaatggtagtggctaccacggttgcggttaaggtgtctcccgactcgatatctctctcattcgccgaggtgctgcgcgatacgaactcgttcataagctccgtaagcgcagatctagtagcgacataagccccgacgaaagtctcccctagcggcgcgcccccggtaccataagaagctgattccaatctccccaggcacattccttccgcataaagaacatcgaggctctccattgggagctttttatgaccacggcctagcagtcgcgcccacgcgcgaacacgattagctttgaaacggtgaagcattcgacccgacgaaacatacaggaactgcgcggcgatactagcagccacacatcccacagtaacgcacgacgatagcatttcaagttcttctttcgtcacagacaccgtgtcagacgacactctcgacaataaaaacacttctgcccgtagcatagcggcagcggcatagcgcactgcacttttacacttcgatcccaaaatgcaacggagttctggccagtacgccagagagccgtaggaagcacgtaaaattgcagcagcggggcccttcgccttacggatagcgccgccttcaaacattttagcgtcacccgtaggaacgcgtggcaaagacgacaataatttggcgcgaccgaatttggaaaagccccctttatgtatcctcaccgctagctccaaagccgaggtaattaagaaaataatagcgtctttctgattcagctcgccagacactacggcactcctcagggcatctatcccgaggcagagaataagcgcgtgtgcttgcttcgccgtccgtttccaggcgagagcgccttttggtggcgcggacgtatacatatcccccttggcatagtctgatctgctgtcagaatgccaaagtggaccgtccccgaaagtattgccccgggtatgtagtaatttgtcttctcgtatagcctcgactcgaggcacgggttccaacagccgccgcaacggaatgaacgtgccaaggctctcgataaacgtcggactcgtgccttcgaccttgatgctattgagatcgggttcggccgataaaggggaagggaccgtgtaagcagatacgacccgctcgtaaggccgtaaatcgtcatcatctcccgaaaagctgtcgcttcccagagattgactcttttctctagacgatgcacccgagcctttacttatccagttctgttttaagtcagacggcgcacgctccaagctgctgtcgcgattaaatgaggttcgatcctcatgaccgccggctctcggtcctcgcctgcgtgacgatccgcggcgtcgtccgcgcacgcgcccagaccgagccgcatgtgtgtattccccccctctagatgatcttcctctaaactggacccatcttctggatcgatggcgaccttcagagccattcgagcctatcgaagaccggccagaacccctagaataatgcgtgcgcacgctagcgtttcgatgtcgccgtctagatgacgacctccgacgtctagacctaggtctcgacctcgatgaggcgtctgtcatgtcgcgcgacgcatcccggcctgaacgatccgaagagcgtccctcccgatctctgcgatagtgcgtatgagcactagcgttgcgatgacgacgcctagacgaagaccttcgccgtttagaccgaggtttagatctcgacgatgcgtctatcgcatcacgcggtacatcccgtcccgtatgctccaaagggcgtctatcccgaaaagtatctcgaatgtagccaataaacccttgtccgttgcgacgactcgtagatccggcagagctcctatatccatcagtctctaggcgatcgtacgtatcgtcgtagttcgtctctgatggtcccacgtgtatgcttgccatgttatagggacttcgcgataatcggacacgcgttttagttccgcgcgttacataatctcggaccgaaccggttctctgtcgctgctcttgaccgacatccccatgacggtgtagagccagcattcgccttcccgtcacaactcaccggcaaagtacggcggccgtccatcgccgtctcattttatacggtgcctaatcgaacggcggaaccgtagctatatcgaccgcgttccattgagaagggggcgcgaggaacggtaacgaagtaaatataataaaatcatttattagctgtcgcttttacgtacaacattgttttaactacaaaatcgtaccgtcgcatcaagtattacatcaccgtttaccgttcgcggcttacattgtgcgagcagcagcgatatcctcggcaatcgcgggcccgggatgtgtagaatcccgcaacatcgctttcacgatagtcccatggccacacgacgggccggccttcccagcgcggccgctctctccccgcgctgatgatcgcggtcttggagggtgcatgagagagtacacttccagctttgatttgatgcactggaatagatacgcggatgccctaggcgcgtttgctaaaaatgcaggcggggctgtcaaaggcataccccgctcttccactaactcgcatcgcatcaccggcagtccgagttcggaccgtacgtaattttgtgttcttaattcggcggcggttaacgcacgcccttcaactatcacaacgccgtggttaaaaataaccggttgaaataaacactgaaagtgtcgtaattggtgccaatcgcaccgcaggtgtgcaaataagttttgccttttcctctgactggcttcgagtcgccgcgatacatctcttgtaaccgaaaggtataaatgcatatacagaagtcttgcgaaccttgccgcttcccggtaatacgccccggcgatagatcgccggggcgtctctgacctgccgacgcacatatcgcatcgcgagggttcgttcgctccctgcctaagataacatgccaaagcacgacaataaccgcaaagtagagtgacataggatttttctctagcttccaattccatcgaaaagaatttttgaatctccgtaacataaacaggcaagccgtcctttgttaatgggggccgcgggacttccatcccgcaatgttcgtttagatttatcgccgtatatgcccatttctcttcggacgccgcatctaggacttcgctaggagagacggacagtagggttgcatgttcgtataagtgcccattaatcggaaagcacgagaacaagtctacgtttagtttttccagccgagataacagggacgggccctctgtaaaatccagttcgtgcaagagcctgttgtacaagcggttcggaggattcggatttggggacggaagcgaaattttgatcgaaaatggagcactcaaagagaacgaggcagattgctccgcgcatctcgtttgagagcaaagagtttcgctaaagctttcaatgccgcggaggatgtccgaatccaaacagtccgtcattccgtttacgggcgcttcgatctcggcggataagtccgtactgtcgcggcgagcatctcgactccccggtcccattctccgcgtcgccatccatctgcttagtagcgcccgccccactaccgatactttatgtgacgctattcactctcgctactatagttaccacgggaacttgagtagtggcgacgtgaagtcgtcggagcgcgaccgggggtttttgagcgacgatctctcttatctaccggagtgctctcgtcaccgtcgcgttttccatattgggatctggacttagggtttcccatatccggcgacagtccggactcctccgataattttcgcgtacatgcctcagcttcatccaataggtttgccccttcttgaatcgtgatcttgattatagccctggcgaggaattcctcgagctccgcattggtcctcggggcgttccgacgccaaagggaaagcgctcccctatatgcatggtactgggccacagcagctacggctccgcagaatatacgctcgttatagacgagcgtgtttgatcgccaggtactagttgctgacgccggagtcgtactaaaggcaaatttccctttttctattgccctggctccgggtttggcacgaactttggaggacagcgactcccctctttgggtttccgatgaggaatcttttctttcgatctttacagatctgcgtctttgtaatgaatgagacgggggggagatccggtccggcgactcgttcttggacgaatctcgtcgagcgcgggtcgacgatatatgggcactattatccggtgacgtgcgcatagttgagcgacgtcgactcgacttacgtctatccgaatctcccattgtatctcgtattaggcagccgattacagacgcgacgggccgttacgtttcaccgtgttgcgtctccgacactgatcaagctgttcacggcaatgacattcttatacgggaacagtagcgcccacgcccacacgatcttaccagccgtcatcgaacatacttgccgtgaatagtcggaagcatgcatggtacgacccggccaagagggcggagattaccgccaccagacctagataaaaaaggaccgagaagccagaagaaaaggctatagacacgcctacggcggaacacgtagattcccagaaatttcctgccacggcgatcggccttcccgaatcgatcgaagtagctcgcgactccacgagggacgcaattacgcaaattaacactttacagaccacatgatggatgtcggacaaacccatccctgcggtaacgctttggaaaagatgtcctcgcacgcgtcgggggctccgtggcgcatgcagttctccgtcgatgaagcgatatatgcgaggaacccagaaggttggacctgttatatagaagaacgcgacccgcgctgtcttcgcgttatcaacgactgtgcgatctcgttgcccaaacgcgatgttaagcggaagtatgaaatatgtgcgttagatctaggtgtacgagtggcagttcctcggaattatgtcgttgtgctggcgaaattgacggacccggatccaacgtctcggggcgtacccgtaatccgcgttgccaatggactaatagattctggatacagggggaacgttcgagtggtacttttgtacgaagcagcttgcaccattcctaaaaacgggctggttatacgtctggcgctcgtgcagttggcctatccggatttcaacagtcgcgtgctttttgacctcgctgatatcacgccccacttggattgcgggcctaacttttcgatgtcgattgcaaccgctgctaaatcgcacagcgctcaggctcgaccgctattgccccctggcggcgagaaactatggccgggaaccgggtgtcgggcactcgtctgtttgtacagcgatcgcgtgtctcgggcaactcattataacactttagacagcaatgtcatatttgccgtaaggtacaatgattctacgaccgttatcggcttaaaagatgtcccgaagtatgtgcataaaacatttgtacggttttatacatccggtcaatttgcaacgttcgttcctttttacgagacatttaatacaaagcggcacgaagatgcggcttacgatatattcgctccgagcgacattgtattggaatcaatgtcttctgtaactatcgcgatacagcagcgatatgcatgtgcggataagtcaatggttccttggatcttcggacggtcgtccatgaatttgcgcgggttgattatttccccatctaggtggatgcccgattcgtggttaacgctgactttatgcaacttaacggaagcaaaagcgaccattaaacgcggagataggatcgcccagctgttgttagtcaatcaggaagccgctgcgttgcttccaacggaaggcggcacggctgcgctgttccctacagtaggtaaatgccgtcgtcccgcagcgtccgcggaagctaagtggagggaaacggcagcattcgatacggaatcgggcaggagcgagagagagtgtgccggcttcgggtcgagcgggcaataatgtatagttgcgcacgattacatacaaaacaataaacacgaacaccacgctgcgttctggacaatcagtttattcagttacacagtccggtaacatgccctcgttgactccacatgtcttagcccttctaccgcttcccttacttacatcacatgacgttgcacatgccgcttgctcggcttcagagtgcggcggcgaaggtagccctcccacccgaccgtaaatatctgctccactttcgtccccgcagttacgggggtcagtagcttccgatagctctaagttttccgtttcgggacacgcggccaacgcttcgagcgagcaatcatttggggaagattttaagcctaacgctctttccactagagcgatatcattcatagcagtctctgtagcagcagttatttgtatcgcgtgttctacgaaggcatccgttcgtcccgtgccgacagacatgtagatctgcaagagggcggcggcacacgtgtccaccattcgctgcgcatttttgcgatgggtctcgacgaccgcgtcgagcccaggggttccttgtcccgaaacatgacgagataggcaatcgagattacggagacacgcactgtacattctagccaacgactggccacgaaccagttttcgcactccgtcggcagacaatatcgccatttctaatgtgatgggcgtggggagcataagattgacggcttgtaccgcctccctgaaacgatgcataactctgtcggaggaagacgaggtagacagtgctgtgtattccggctgaatttttctagagcgccttcttaacccggcgtgcattgtggccaaatcttctattatgtccgatataccggaggatgccgaccctgggatcaaagttttgtttgccgttgatggttgcgccgtctcgttctcccttgcacttcttacgggtcaggtcccatctatcaatcccgtctacgttatcagccactgggatccgggcaatcgtttgttagatgtcctttgccaccgcgcagacgatcgcgactgcggaagaataccgaatgaacgaggagatttaaacgcggtctccgaccctctaaaagtagagttttgccttctcagtcaaatgacacgcggtttgggcggcgccgatttaaaattgcggacgcgagcgatattcgtgtgccggtttacttcgcattccgagattaactccatcgtggcttctatagcttccggagcgcctattcaaacagacttattaatagccaccctctccgaatatgacacatttcgcctacatgatgacttcaacatcgccctccacatctctctcgcctgtttatcgcaaaagcgccgcaatgggaaagagccggcaaaatcaccggatcgaaatctgctatcgattatggcgggaaccttttctggaggtcggcgcggtctagccgggctgtatttacaatacgagcaaaaagtcaccgcggcctaccgacgtgtatatggggggtcgacgacgacagcgttctggtacgtgtctaaatttggaccggaagaaaagagcctggtcttggcgctacgttattaccttttgcaagctcaggccgaacctactgggattgctacgggttacgatttacaggccataaaagatatctgcgacacgtacgctgtacccgtagaggccaatcctaccgggttttcgacggcagacttgacatcgtttgccagattatcgcgtttctgttgcgtgagcaattatgccaacggtcccgtagctagggcgtttcccctatacgtggaacacagaattgcagccgacgtgacagaagtggatgcattgaaagagtatatagaaagagaccggtccgggttaaagatttcggatttggaatttgtcaaatatatttacttggcttacttcgagtgctacaatcgtgctcaattaagacgtcatttgcgagacgtgaccgtgcgttgtcccgaagaagatgtctacaaacgctcgtctctggggaaacacgcagtcgataatttctttacgcatgtgagatccagactaaacgtgaacgatcacatagcatgtaacgtatctccggatcaagtggaaatgggaaacgttttgacccgagcattttgtagggccaggacctatccaccgagtaccatggaaagcgatgcgcgtttcaccgggatttgcgaaccctcgtcggtgattataaagcgtctggatgccctagaatcgacattacacaaatacggatggccgcgcgcacggtctgaaacagttaacatgatgtcagagtgcgcgaatttgcccatcgcttcatctgccgatagtcttaggccacccggcctgccgctagaacatccaggcactcattgccggggtggtccaatgatcgtaaagcgcctactagcgctagtatccgcagatgcacgtgtcggggacataggaccgacaaacatgctcaccggcattcgggaatcggccgtcaagggccctcttccgatttaccggataggcatgtccaaaggcaaacaagcgtttgccgtgatggtggccgattgttgggacaaaatcatcccgtctccgggaattgtgaaagcccatctctctaaactcggcagatccggtagagcccccgaagacgatgtgatcgcccgagatattttttttacatcagaacttgagcgagtcacgggccatgctgcggaactgccgtactttacctgcggccctgccgaagaacaacagtacataaatcgcaacgaagtgttcaatgacaatcttattgtggggaacataatcctggatgtcgatgtgcacttacgaacccccgtacccgtcaaacttttgcatgtggcaatgagaggttttaggaccggtgcgctcaaagcgttgtctctattacttccaaaagcaaaaatagatcacggctcgtacccgtgctacttttacaaaacctcgtgcaagaaatctcgagtcgtgcacgtaaaacattggatgtcgtctactaccgacttcgctctcgactgcgacggtcccgccgtcgaaagtgcagactgcgaactagaaatgggcttcgatgacccgttacttatggatcaaattgatgattccatcagtagatgtgagtcagatgcatcaagtttgccgtcggacgccgatctgccttgtaactgtcacgaaaaaataggattgcgggtctgcattccggtgccgcccccgtatctactcgtaggtagcagaacaatgagcggtctggctagggtactgcaacaatcggttctgttagaacgtagtttcgtagaacctatcggttcgtatctcaaaaactatgatatagttgatagcggagtatatggtcacggtcgcagcttgcggcttcctttttttggcaagatagacgagaccgggcttatatcaggccgcctgcttccgttttgcgtgataccggagcgctgcggtgacgcagaacagttcgttctgtctcatttacagcctaaaacctttcacttccacagtcccatgcccgaagaagatcacgcgtctgtagttctgaagggcctaggcggagagtatgccggattctttgaaaaaaaaatcacgatcaatagagatacgtttttcggaatcagattatccttagcggtagctctgaaagccaggggggttgacattaacgactctgcggcaatcgtatcattcgtaacggagcacattttagatgacataattcagtacatgcatgaccacatacccgatcacgctgcggaatataatcacgtttctgtttcgtgctgcgtcattagaccagattggatcctcttgcagctaatggccaataaaacattgggacgcgctcacgggtttacgtgcgtgaggtttaagcatacaagaacgactcgaatgagttcgcgttcgtatttgtctttaaacatcgacgcacatggtaggttgtgcgcgtgtgtgattcagcagtgttttgcggccaagtgtggaaacaataaactccgtactctttttacggtggatgtcgattcgaaatgccaggcagaacatcgatagccctttcgggaattatactctgcatctcgacatacgccatcgctttggtgatctacacgacgatgatagctaaacacggttctgggtgcatctatgccgtcctggtagacagcgatcatcgcgatgccaaaaattttacatgggagccatacaattctacactggtatacacgccgctggggaataaattaccattggacggaggatttggcggttttagcgatgtatgtaacacatatctgatcaacgcgacggatttattcggacgcgcgtctcacgcgtccgccaagtcgaaaatccgttcggtggtaggaacgcgcaattgcgcagcctacttttggaagacgcatatacaagccttgaccttttccctaagttcgtacattatgttttgcgtcattagagaatggagacgcatgtttggggtggtgcgatctgaaaacgacagaataccgccgacgacgtacacgaagaattatactgccagggtaatcgctaacggattgctaaaaacggtatatactagaatgtctgaatttatgtgcgagattactatatacaaaaattctatgtgcagaatatttacagacgaccctatctcgtttatcttacgtcaccctttggctgcgattctccttataaccgagcggctcataaggctcggcgcacagtgtctgtgtgtactaacggtatcgattttttttgtaccgtgtaaaatagttttatcgaaatggttcttgtctatcaccggagttttcttaggaatcgttatttgcaccgagatgggcctgctgatagacccgggaccggctgaaaaacctgtcatgtttgcagaagttgccccagcccccaaaacccagcagaacggcgtggctgtcccgttcggtgcacacgctgtatgttccaattgctgcgcctccataatctccagcatagtcatcaaagttctgtacgtgttattcatggttaccctcatcgttaccctcgtgcgatatgaacgagcgctccagattgccctgttcgggcgtgcgtacctaccctaaaacattagtggccaagcctcctatttgcatcgcgcggatgtgacacgctaaccgcgagaccttataaatggttccaatgagtcattcgcccctcgggtgtacgcggtattctacagcagcgtattagataaactacacgggtttgccgtcgcgcctcaaggaaaatgtcagtgggagctttctctcgtgattgggacgatataatgagtttgtcagactacgattttacagaggaagaatccttagatgaaagcggcgaactgaaagaattcaagaacacgtccgcgttgaatgctattgagacagcccgcgacgcaattgaaagatcagccaattcaaacccccccatcgaagaaccgtcgttcatctccaaatctcatgcaggcgagacctcggcctcgaaatatagaagcttgcccctcgacatcgaaaaggcagaacggtgtgatgacactcgaggctacaacgtgagttcgggaaaacgaatgcgtttggcagtttcggccactgttgacctgtgcgagtctgagatcgaacggcaatgtctgaatacggaaacgcgggaccgtgcacggtcccccaaacattttgcatcccattatgaaatcgccgccaaaatacacgatcttcccagatctacgggaaaaaggcaacggcatcgcacgttagattctcgctcacgacgccacttagcgggagagcatcggcggcggggagctcatgacgaggaaagcagacacttttccctcagaatgcgtgaccctcattcagcacccggcaagagcccgctgtcgaaaaggcgcagtcccgttaggctccgtaacctctctgtgcaggaggaacttaacgcgatgctacaacgagagaaactgaagctcgacatgatttcgagagagcgcaatttccgcacttctagcaaaaaccgctgggcctcagtactggcattctcctgtaccggaaaaagtggggcatacgggtctcagataacgtggcaatatttgcttcaagagggaccggagcttagaaagacgttcgaaaatagacctagaacctcattgctggcgtctgcggcgcgcgaagctgtgttgcggggcgaaaacttagttgcggcattggagagcgccgaggaaaccctggcatggctgaaattacactctgttctaaaactgcgtttaatgaaccatgaccctattttcaggacggcgggtgccgtcttagataatctcaagctgaaactcgcacccataatgatgtgtagaaatggtacagacaaacggtcgttaggagacatgctgagaagatccgccacggacgatatcgccgattcattgaccttatgcttaattttgctatcgcgtattcatcgcatgatgatgtatcgcgtgtcgggtagaaaagatagttccatgatagatcctcggggatacatgagagagtatactcctggtgaatgtatggcgggtatattgcattacgtagacgcgcatgcaaaaacgtgttccgacagagcgtgcaatttatatattagctgtacccttatgcctgtttacgtacacggcaggtactttcgatgcaattccgcgtttgatatgtaacctactacagacgggcaattttgtattcttcaatagctttatttgatatccattaaacttaaataaagacaccgatattcaattggacatgaacagcgtgcgttttattttacacttagcctgtgtgctttcgacaccgagtaggaaaacgaaggacctgaaattgcacgcacgaccgaaggaaataagccatcgcaatcgcatttgaaatccaagtaggcaaattcaggagaacctatcacttcattgaacaagttctcgagtattcttatgaatgataagcactggagcccgccagggcgatcgcagacacaactaattaacatgccgtgagtgctgaagttctctctcatggcagattcgcataagtaaatagtcttccttcgagttcctatctccgtgaatctgcgggggttcatcagaagcgcaggtttgatttccgacgtgtgattagaatgaaattgtcgaaagacagtctttagagtcattggcatgtctgtcagtactatggacacttccttgcggcagcgatcggtaaggaaccacagtagttccttaggtagtatgtttctacctaggaaccacggtgttcccacggccaaaaaccaagcgtggtcaaacgatccggtgctcggagaagaacgctgcgtatccgctacccaaagcagtatcctttcgcagatagacgacgttgccgtgaccattctccctttccaacctcccgtcagtacactgtttattgggcccccggcgtgcgtgaggagtaccggtctagcgactattccataaacgttagtcggtgagagttctctcggggtgagccacattgggaagcccgtctgggttggagcgtccgatgtagagtcgtaattggcgcagcgctgaccctgcggtctacaatgcatggtcatgctagacgggacaactagtcgcccggtgcatttttcattacggccatcccttacgtccacgtaccacgtgccgtgagtgtgtaggtaacacgtagtgggcgtggaaaaacttatataacacccggcagaaaccacgtgcgcccagcggtggcagatcctcagttctacagtgtccaatggcggaaagtacagctgaaccgtcagcttcaccggtacgaattccgtacgtttggcaagtgatcgctccgttagcaattgacgtgccgtccgcctctactcaactagctacgggcgaacatgtgtcatgtgccgcatccgttattcctcgttcgtacgtcatacgggcagcgtgtaaatcgtcgacgactttccacgcgttcttctttggattggcgacggatccgtctgagaacatgtcccaatgcggtgcctcgtatatcgcgtatagaatgaacaagaagttacggactggtcgattgacaggcgaccaatgcgagtcgcctttttctcatgcgacgatcatcgactcactggatgaaaactacagcatggctatagagggactgtgttttcattgccactgcgaaaataagttttcgctcgagtgttggagatcggcttttagcgctgccgaaaaaatcgcatcgcagtgcagagctattcgcgagtacggacactgaataaaaacgaatcatgatttgatctaccatttcagcatttattggtttatacattctcgggttcgtatgtatacaaaatcttatggcaacccgcgataacaattcatttacgcataccaattgcgagagctaggggcgcaccctcaggttcgcctacgccggtatagcgttgagatctaatacgggagtagtgattttgcaggaatgtaagtggtagtaacacctaaagaaaaccacatactaacgctctactgttcactcgtatctacgtgcagtgaggttcccgcatatgtttgcgcgtcatcaatcgctctcgccagtatcgccacaatgcgtttttcgcgcgcgggtattgggacgcagtgtaagtggaatagcattccgcaggcaaaaaagttgtttgtcatgcaagcatccatcaagtagcaatcacatagtgggaccagacgcctcaaagcgacgtagtggggggaaccctcttcccattgcaaccactttcgaaatctgtaggtatatgctgccagccagcgccttgttctgacggttattaccctgaaccccttaaatgggaagaagaatccaaggtaccaatcgttggcgactggcccgtgcggacaacgggttaaggatgtgacaaactgtgtttgcgtgggtacgtttacgatgtatttcgaatcccgcacgacgcattcctcccagtgagatagtagtatcccataattcatgcatctgactaccttgggggtgagacacgctgtaatatgaggcgtcgcttgtaaaacgcacctgtatggaaccgttccgagttcggggattgattctatgatagcaagtctacttattccggaaaccgccatgacatcgcacaaaggaagcagttggttaattgcatgaatcagaatgtttgtttccagcacggcacctccaaaggaaaataatgtttcgatgcacgttcgtgccccgttctctgtattacagcttactagcgcaaggctgaggacaaaaacgagttcgggctttgtatgttcgagcggaacaccaatgcgacataccgtatcgcttaagtttttcataaaagtggatcttgcacgtttgccagatctgctccaatcggccgaaaaaaatttgcgcacaatcggatgcatgtctgtgcctacaaataccatgaaacataattcttgtgctggacccccatccccgctatctatatctacattgtctgacatgtgttgtgccgacaacaaacggtgtcttgtatccccatcaatccagcgctttctgaggtttacgggctttaggatggacacatcaccgcatttcggcacgcataacgcgggcatgtctgaacgggcaacgattctctctgtgagcagatcgagacggccgtgacgcacaccacgtgccggtacattaggcacgactgtagcaaaaggatggtagcgatggagccagcctaccgacagtcccgcaaaaaatcttatcggcggaatgtctcttttaaggggtagtgtgttacgaaccgatgaattcaatttctctgtccaaccacttatcgcttccgcaacagaaaaatcgtttctaagttgcgaatatgtttctaccacccacttgagatcgctgcgaagggcttccgacatttttttagcgtattcctcatctccatcacaatcacagtcgtgtctttcatttgcaagtgtgggcgcgcagatgtctacgcgacgacttaaccgagacactgtttctctagtgtaccggtaacatggactggcgcccgctctgaccgttagcatgcgtttggatgcaaccgaggttagataaacgtctggagaactgcccaattctttgctttcactggcacatatccaaccgtatgtatcctctgtctgtcctgccgcctcaaagttaccggggagaggtccgggactcgctagacagaagtcgatttgggaaaattctgtgtcattgttgtagggactgtgcggcctatctaccatagttgcagaatcgtgcattagaatttcagcgagcatggaatcgatacgttcgtcggcacccgcatatacggcacctattcctattcgcgtacaagagtcatcttctacatcaagcttccagaacgttgtcaggtattcgccataggctgcaaagtctgcatctgtggttcttcttacaaattcaatctccgggttccaacgtccacgtcccatacataggttgcgcaacgtgatcgagtacgccaacgtattgaaatcatttatgctagatgcttcgctattatcttcgaacaaaattatcgtatacaatttcgattgatgcatcgatcgaaggactgacaaatctgtcgcatatgtctcctcggggagaggtgtgacggtgataggctcgtccctacgttcgaaccggataaggcctactgtagcggtggtttcagtagtcctgatgcatcgtaaaattgtggcctcggttctaattttcccgagtaaggcccacggaggtccgcaattactattacacagggcctggattacggaggaagtgccagttggtgcacaccgaaactctggaaaccattccttggacggaataggagggtggaatttttgtcgtttagtccactccatctgttcgtacatggaaaatcgtgttaattcctgatcgtcgaaatgtgctaatggagctatagtgctgcgttcggctggtgcggaacctatagacacgacatattttggttgcacgtgcagttctctgagctgattaggaaataatactgcgtttgatgatagcaaagacctttcgggatcgagctccggagtgcagtgcgaagcgtgaacaattctacttttcttccgagacggtgtgaagcaaaacatcttgacgatgctacgttctatggcattctgcaacaataaagtatcaaattattttgacattatcatctatagtatgagcggtgtgttatataagaggacgaaacacttgtgaagtagacacgttttattcaggaactcacattttcactactacgctgttgtgagcagagagataagcgcggcggaaaaaacagtcacaaatactactgttaatataatgatcgcagccgcatcctgtcgggcattaaacaaccaatcctcttcatcattagtttccgaagagctagtctcataaggcggcggaggagagtcgtaggtaggaggtggtccatttgaggcttcatacggaggcaaatatgcagcgtcgcattgaccgtcccccagttgtaattcgaaatgttcatataccgattccccgggagcgtctaaaaatggttgctcctcatgtaacgcttgcgcttcgctcgtcagaccgcggtctagctctgcgctcgtaagttcggtttgcggtcggtcgctatccattttccctcgcccgcagtaactgtgtcgatggttcactactctcgaaggagttaaattgcctactttctcctcgaatctcgaatgtggctatgcagcatcagggtcattagcgtcagtattttcctctttggagtctatggctctaccccaaatacctcccgcgattgctcctgtgcataaggccataaacaggccggccctctgccaacccgttgaatccaccttcactgctctgccaattagtattcctgcaaaaaatgccatgcatgatcccattactaatgatcttgcggaccgaataagcgtgattaccattaaggagcgcattgtagcattctcagattccacagataaaacagtacgaggtactgtaggagcaaggcgctgacctacgaggttttgttgcacctttcccgctcctttttctgctatcatcagtaagttaatggactgcacgatttcgctttcggcccggaggaggcggcgggcatcttgtaccgcgcgctcggcgcgccggagcaggcgcgcgtgcgcctcgtccgcgtccgcgcccgcgtccgcgcccgggtcgtcgcccgggtcgtcgcccgggtcggcgcccgggtcgtcgcccgcgcccgcgcccgcgtcgtcgcccgggtcgtcgcccgggtcgtcgcccgggtccgcgcccggtccgcgccctccggcgtcgttctctccggcgtccgggtcgccccctccgtccccggctccgctctcgcgctccgcatccctctcggcgtccggaggggcgcgcggatcagcggtcgggtcgcgatcgcgtccgtcggatcggcgccttttcccccgccgcatcgcgttccgccgggccggtcggacgggagaagaagggggagggggggaaggaggagaggggggagggagggtagccggccggcctgcagttcgggaagagcgggggaggcgccgtccgaggccgccggggaggaggttgtggggggcgggaggatgtgtgggggaagggaagggggagacggccgaaacctacgcgttcgccgcggcgtccgatccgggatcgctcccgacggggctctcgttcggcgatcgcttatcctctgccgccaccttgcgtccgttcgcgggaagcgccggaccggcgctctaagcggagatccggcgcctccgcttcttatgaccgggccggtcgtgagggcgtaacgatcacgtgatgcaatgcaaacgagcggggcgaacgcgtcagcgttcgcaccgcgaaccaatataagattatatatataatatattattggcgcaaggtgcgaacgcccgtccgggccaatcgggaagcgggatcctatgccacgtgttcgtgtccggccgcggcccgcgccgggggctagaaacgccgcccccctcccacgggggcggattcggggacctccggcctacaaatacgcgagcggaggtccggcggggaccgtcgttccgctggccggcccgccgtccgaaagcgcgggaccgcggtaataaagcgcccgccgtcgcggatcggattttctggtcgttcttttaccgccgggcgaaccgcgcggcgaacgaacccgtcccgttgggatcgcaggcggccgggaagcgatcgcgcgccgtcccgagaacgtcgtctacggctcgcgttcgcgggggtcgccgacgggtggaagggggatgggtaccgagggcatcgaactggccgagctcggcatctccgccttcgggccgcgaccctcgcggcgtccggaaccgtcggacgtcgagggaggacgccccatcgttctcgtccgcggatcgtcccgatccctcgcacgagaacgagatccgaccccgcgtcggcgacgcggccgaacgccgctcgcggaacacggtcgcgggtcgccccccgactttccccccggccccgcacccgcggcgaggtcggaacctcgggaatcgattgaaaacgggccggtcgagataggaccgctctctcgttcggaagcggagcaataaagccgttcggcgtgagctcgggatgagtctcggacgcgcgtcggtccgtttctgcccttgcggcgctctacgaaagaacccgatgaggccgcgttctgttcgggagcggtcccgagctgtagggatcggctcagtagtaactcgtctcgggtttcgatcgagttctagcgaaccccgaaaggggggtacgaggaagcttgcggcctgccgcaaaaagactccgaggagaatagcttatccgcgatacgccgccccctcaaccgttcagcactcacttcggcgtcagttccgaagtgactttgtctggccggctcggcgcgagccggcctcggagagaacgcgtacatagcgatcgtgggctgggcaacgagataggagtagagggatggggaaaaagtgaagtcccgcgctggctctggacgaggcggaacgaaatgggggaggggacggcctctcgaacgagagcgggggtggggcatggtcggtggaggggtgtgggaaacgccgcgacgccgcggcccgtccatgtggtaatgcggggaatagagttccctgacggggaggagttgtcagctcaccggtcccgtgatcaacgcatatgccacatatatgcaaccccgcgaccctctcctcacgaacagggtagagggtctcgctttgttgcacacacaagcacactcacttttgcggcgacaatgaaaatcgtgagcccagaccaattgcccctatatgtgttaacggcctccgacggaacaacggagttcagtattcgagattggtcgctatgggatcgggatccggaatcccgtgcaggtacgcaccgcgggctccgtcaaacggaacgctctcttttggagcgatgtcgtttgggtccgggcccgagtagggttcggccggctatttccctcccccccccccccccaagcccgtgcgggaccgaggttgagtgggaaggtctcgcctgccggatcgggggggaggggaaaagacgtttgcgttatccggaatcgagccggaccgttttacgtttcagagttcgaacacgctctcacgagctgcagccaccggctcaagccctcagaccgcgtccgcgccccgggccagcctagcgtcgcaaacgtctggaagagtctgtggagtttggtttcgagggccgtgcggggaaacgcagagggctcctacggacgaccggaggagggagacgccgaaactgccgtgtaaacgaatgcttagcggagccgcgcccgggacgcgtcgtttcttgcgaaacggggtggatcgctcgcccgctcttagccctcgcgtacagtgcgtcgatcgttaaggtgtacgtgcgtgtacgagaccgcgtgcgagcggtctcgtcgtagtgcgtatgaacgtgtttattaaaaagtctttctcgcttcggtcccgtttcggtgtctggcgatggcgcgggcgggggagtccgtcgcgtaagtcggggaacgtactttgtcctctcctctcccccgaggcgggatgtgcgagggggggggcgacgggcgaccgggaatgcgtgcgattagtgttgtggagaacgtaccgcgccgaggcccgcggtgcgcgcgaagggttagttgggggaggggcacgcgcatcataagtcgctcgcggatcgtccaggtgtttgtgcgggggatacagtttcgcgacggggaggagccgttagctcaccggccccgcgggagacgcagatgcgatataaacagccccgcggtccacctccttgttcgcgacctgctacttagcctcgcttcgttcccacgtataagcaccactgacttacgcggcgaccgtggaagtcgcgagttccgaccagtgtcgcgtatatgtgttaacggcccccgtcggaaccgaattccacattcgagatgaagtgctacggaatcaggaatcccgtcccggccgcgcgcacacccacacacacccccacacacacccccacacacccccacacacaccgcggctacagagcggctgtcgtagtacgtataggcgcgagcgcgaacacttgcacggactctcgtcgtagcacgttcaaatcggtttattaaagccctcatgctcagactccgtgtcgatggcgggggggggggggtggtgagtgacacgaacttactttcctgcgacgctcccgagaggaggtgtgcaccgggccgttttctccgagactgaaaagagaaagaaaagctccgccgttcgcccggccgagcgcccggacgcaccggtgtccgtacggccttcggacgcttagagagcgcgggcgtttcgcgccgctgcggcgtttaggcgcgcagcggcgcgtttgcaaaaaaaaagaatgtacggagagacccgcccgccagcctctccggcccggagcggaaacgccgcgttatctctacgcccccgacccgcacatccgaatgcgcggtcggatcgcgaggttaactccctgcccgcgcccgcgctccgcgctccccctgcgttgtttaccggttcgcgatcgcgatcgcggaagtcgcagggccgacttccttgtttacattgaatacgtcgacggaagcgcaactgcgtatgtccgccgcgcagacgcagaagcgccggggccgaatccgggaagaagagtaatacggggcttctccagcgcgtaagtaccggcgttccgggcggtcggcgagtcggcggagaaaaggtggatcgcgagcgcgatccgaatccgcgggccgaggggaaattcttcctatcccctgtgcgttgagcgccccgtgccgtgccgcctttttccgtttccggtcggactcggagccttcccgccgcacggttcggactcccccccccccccgcaacggttttattttcccgcgttcgaccccggcgtgatgtccgcttttctgttaaaccgtgcgttcgtcttatagggaagccatcttaattctgacatgcgcgaatgcgtctttcccccttccaaggcctaaccccccccgcgctttctcgtttccgccgtgggccatttatcttcccccccgcgtaaacaattatccctcccccgcgcgtcctacttttcttctgagacctatcgcctttggcgattctagtcagattgccttttatagtcaagtttcgagcagatcctaagcaagcatgccctgtaccccaccccccttctaaataaatttccgatccctggaggtttccggagtatttgtcccaggagcggggtcctatgcagtaatcgtaggtctttcatgtatgggggggggggagggggggggagatgcgaacgcccacactggtgttggttcgtccgccacggaagctggaaccccatcggacgtctcggcgccctgtttgcaaaatgtcaggtacttgtagtgcattccacgtaggaaaatggtcgtgaggggagggggggctgagtttttctgttatgggtatcctgaggggtctacgtgaaagtgactggccttccgttttcccacagaaacgttgtgtggtacggtgcaccctgagagatgatctatattctcaggaagttccgtgcccgaaacgctctgaacgataagcttctagattgcatcggggattcctctgagaagagcgggtggggaaatacatagccgttaaagtctcgcggtccgatatccccgtttggccggtggatgagtcgcgatggccggacggggccggaaatgcgatccttcttttgcgggctatttgcgatggaagggaaaggcaaaccggaaaacttaaggccgtttggtgtgtttttcccttccatcgcaggtcgtgccgcagtacttttgaatcggagggagacgtcgggcgagtgggaatgggcatcgcggggtcatcctttattctgggacgaccgcgaatctacgtgtcgtctcagtctggacggcccatggaaaaaaaaaagagtcgagaggcgtggggggggggggaggcctgaacggccggcgcgataagggatacgtggtcaatcttggcgattaagcctagatattgcgcggggagtggggcggcggtccaatgcctagaagggcattattcgaaatttggagtcgggctgcgtagcgacgggtggcgcgcattaatacccctatcttttttttttttgcttcgtttcttgtggccggcttgggaaatgtcagcggaaaacatgcacccgctgtgtgaatgtaaaccgcgtaagtaaacccgtgttagactagatttcgcaagttgcgaaggggggcgattggggaggaggaagtctgaacggaggggggagaagggaggggggagggggaaggctgaacggaggggggagaagggaggggggagggggaaggctgaacggaggtgggagaagggggaagaagggagggagtggggaggggggggggagaagaggggaagggggaaggggggaagggagggggggaagggagggggggaagggagggggggaagggagggggggaagggagggggggaagggagggggaagggaggaagaggggagggggggggaagggaggaagaagggaggggggaagaagggaggggggaagaagggaggggggaagaagggaggggggaagaagggaggggggaagaagggaggggggaagaagggaggggggaagaagggaggggggaagaagggaggggggagaagggagggggggagaagggaggggggaagaagggaggggggagaaggggccctggcgagatcggctctgaattcttcgttgtagatagcagacgaccgtaaacctgaagtacctgtgacttggacggtgatgagatgtttggcctagttacagggactggcctttgttagacacgatggcctttggaaacgcatccagtctgttttggcatctgagtggcgcgtagccgttgtcagatgccagagagactgaaatgtttctcgaggactctaaccgtaatctgaataggcccggaccttaatcccaataggccgtgccgggatatcagaggagagccgctcggaccgctgcgattccatccttcgactagcgacttgttatggcgggtaatagccggacgacggagtctcggcggttcgaccttagcgggccccggataggtttctcggttggggacaaaggggaggtagaggcgtcggatgcggggcgatgagcgggtatttaggccacgagatcaggtgttgtgaggaaggggtaacgacgccgtattgcggtcggaccgcacgacggcgcgtcgtccagtccttcccgggtcccctagaggtgtcacgttctaggacaaccgggacggacagggcgacgcgcgcgaaatgcctcgtatcgcctgatatgctcggaacgagtcggggaagggcgcgaaagcgagagttactactcggaactcgggactgttcgtatgttttctctcaggctggcattgcacgtgtcattgccgttgtgcaatgcctgcggagagaaagacgaattgattccccgtgccgctccccgtcgtgtgggacaaggttgggagggctctgggcgaagaaccggctgagcatcggcgcgcgcgccgtgtcccccctcggcggtgtgcacgggagtatcgggcgccgtcctcatgcccccctccgagggtagcacgcggtggtcgctgcggtcttttcaaaacaggttctgcgaagcagagatgcgtcggcgcgcgagcgaagcgaaccgagctctgctccgtccttagcgtggtgcctgagattttaacacgtatcgtctcaagtactgcgcgcaaggaccgaggcggcgttccaaacgtcggacgggacggcgcggcgtcgtcgcgcgccgcggaaatcgttacacgctccgcttcctccttcgcggggtgcttgagatcaccgaatgacgggatcgagcaccacgccgatggacggagatggcgcgcggtacgttcactgaatcgcaacgaggccgggccgcgctgcagggatggccgcgggtacgcgcgccgagtatgggggggcgcgtgctctcctacggccgactcttgggagcgtgcatcgttcgggggtcggctgttgggtaagacgtggtctctttcaggtcggtgctgttattttcggcggggcgcgggacttcgtcctgggccgtcttacacgcacgtcactctggtcgtatcggtagtcctagtggcttgcttgtaggctgtccgtcggaggaagacagcaccgccgcccagctgcctgtgcgagcgcaggactcgtgtccacgtcctgcgtgactgttcgcccgccgttcggatggtccgtggtacggtgtcctgtgttgtgtgagaggtctccgtacaccggaccatcgaaggggggtgggggggatatgcgaccgcagagcgacttttaggctgccgctgtgcagtgttcggttgggtggggagggaggaatgtctgtaaatcttacggcgatatgctggatcgtgagaggtgagtacgtgtctgtgcgggtaggtgggagcataaccacaaaaagactagaattctgcccgcggggaaatggcggtgtgtgtaatgcttctgttccaaacgaaggtgcggaataggagcgaaatggaccgaccttcccccgcgacgacgtaagtggcttgttacgacctgggaggcctagctgtgttctcgctcgttgccagtggataggctcgcccttttttgtaacagatggcgatggaacagaggttcctatgtgggggggggggggcgggaaggataacgtctatcgatcccgaagtcttcgttgcggatatgagacgatcagtactctcaccgatctgcatatcggacgcggaggggcgagagagggcccgtggttaggcgtctgtactccgaactgcttccattttttcccttacggtgcctgacgtcgtattttaacggttagatgccgtcagggaaagatgggagtttgtttgctcgagccctgccggcggactgcaggcgaagaagtagccgggcgcgaagcggctgggaatcgggtcgcgtggcgtgtcctccttcggacgagtgcttgccggggagtaaccgtcatgcactactccgggggtaggacgcgacgtgcgacgcgctctccggatcggtgccgtgctgcctgagatcgagagcatcggacggagcccagcgccgtcctttgtgctgtgtgtgagaggtcgtcatcccttctcgggcaccgcaccgaaggatggagtgggccctcgaaacgtcatccggaacgccgcgggacgaagccgccccggtaaagtccagacgcgcgcagttccctccttcgtccggtgttcgaggcgtgagacttttgtattgccgcgtcgagcaccgtgctggaggaaggagatggcgctctactccgggacgaaggcgctgcggagcgcatcgcgtggtgttagaggtggatcctgtcatcaagcaccacgtcgatggacggagactgggcgcgaagcgttctgcgggatcgcgtggaacgagggcgcaccctcggtcgcgattttctcgacgcctaccctcggcgttgttcgtcggccgagggtaggcgcagaggaaatcgcggtcgctgtggactccggtgtctggtatcatgtccggctcgagtcgtacgtcctgaaatgttgcttctgattccgacgggtcttcttcacgtacctctctatggctgcatctttatggccatagtgaggtacgtgtaggctacctgccggagaaaggcggtcccgacgaatacgcgtcccgtgtagcggtcgcccgctctgcgatgggctggttccggcatcaatattgcagggtctatttttgtggtgggcgtgaccgcgcatcgcatcgaaataaatctttaaaccggccgagttcattgttgggctatgctcggttttcggggggggggtgtggaaggagggtactaggttagggttagggtcgggcccttagggtcatggtcagggttaggcctttaaggtcatgcttaggtctttaggggcagggtcgggcctttagggtgatggttgggcccttaggggcaggggctcggggtaagggttagtgccagggtcgggtgtcagggtcatggacagggatatgccgttaaggttagggttggggtccaaagttaggcgtttaggggtcgggtcgggttcggggttaggcctttaggggttgtgtctggtttagggttaggcctttaggggcagtctcggggtcgtggttaggcgtttaggggtcgggtcgagttcggggttagacctttaggggtagtgtcgggtttagggttaggcctttaggggtagtgtcgttgtcggggttaggcctgtaggggtagtgtcgttgtcggggttaggcctttaggggtagtgtcggggtcggggttaggcctttaggggcaagctcaggtgcagggtcggggttaggcctttaggggcagggttagggtcagggtcggggttaggcttctggatcgggtctttagggtcggggttaggcttctggatcgggtctttagggtcggggtgattatgatcagagactaagagcgcgaaggcctatcagtgttaggttctctgggtcagggttaaggcctcggggttagggtctcaagggcggcgtttggcttaggggcccggggttaggacctgtcaaggtcagggttatggcctatcagagttcgtggtcacaggtgtaagggttattagggcctattaatgtcaggccctattcgggttaggctcccaccgagtactaaggttagggtcttgtaagggttggggcccgtaagggtaggggctggggtctgttacgggcagggccccccccacacggttcgacctgccacgcttaggttcccatcccccctcccccccccgagtagggttagggcctggcaggggtagggtaggcgcgaaggttgggcccgttagggctaggagcgaccctcctccccccccccattattgttagtctgttaaggaggcgttccccctccccgtcagggttagggcctgttaggggtagggtaacagggttaggttaggggttaaggtctctcggaattagggcggggcgtgtaatggttatagggtcagggcgtgccgcggattgagggtcggggccggcgagggtgtcgttccggtgtttacggaaacggcggatgtgcgcgcatgcgctcgcgcgcgagccagacggacggacggacggacgcgtctcgtagcagcattccatgggcgtttttattcgtactggccgacggcttcagcccgggtcggggctaggagcgcccgcgtgcgcgatgaagccgccgtctcccggcggcgacgcaaaggctgcggtccgcggttcccaagcgtcctgcgtccccgccattgctgcaccgctgccggaaaaagaaaaacatcctgtacgcacttcccgagcgccgggacagaggcggtctccgccagccccccgcgaaattccaaaaagccggtgtggcggactcggccatggaatctacggggggggggttgagggggggatgcggcgctgtagtcgccggatgcagtcaggacacggaaattaagcgcgtccggacgtgccggacaatcgcgtacgcggaagtgcttgcacgggaagtaaacagtggaccgcggcttaccttcccagcaggagtacggtgttcgcggagaaaactgtaaggcgggagcccatcgtcgtgcgctcccggtcctctcggaatcggctgcgagtctcaaaaaaacaggaaaggggatcggcctcacaaaaccacttcctcattcgtgactgcgcgtagcctccgttcttgaaagcggttggcgttcgcacagacctgagtcgacaccgcctacctgttgtttactttcaatgtagtgcgttgcacagagacgctcggggccgggtacaagttgcccgggtccgcgggtctgaagcacgcactcttccgttgaaggacggggtgggaaagcggattattggaccccgcgatagggtctgttagggtcgggggttcggcctgtcatcacggtcggggttagggcctgtcttattcgttttagtgcctgttagggccacattaagggcttgggccagggccgtttacggtggcggttagggcctctcggggtcggcgtcaggactgttagggtcactgttatggcctttcagggttagggtaatagtccatagtcggggtcaggacatattaagggtagcggctttggcggttacggcatgtagggctaggaccttttaatgtaacgggcagcgttggtgtcatgtatcacggtcggggtgactgttaggcctcgccgggcctcatttcacggtcggggctatggcagggtcagagtctgtggtggtgtgcttcggtcacccactgtgtccgcgcaatgctgcgcgttcattctgcctgtagccgacagttcgcggggtgcggcagcccgcgggctgagtgcacctgtggcggcgggaggctgcggcccagccgcgttaattgttgtgctatgttccttttttggggggggggtgaaatgcagggggggatattaagttggttagggttagggttagggttagggttagggttagggttagggttagggttagggttagggttagggttagggttagggttagggttaggccgttagggttagggttaggcctttagggttagggttaggcctttagggttagggttagggtgaattttttttattcagttcgccgccgcgagagttttggtatgacgtttggtggtggccagggtccgccgcgcgcatgctccctacggtccgccgcgcgcatgctccctacggtccgccgcgcgcatgctcgctagggtccgccgcgcgcatgctcgcaaatgtcgactgcgcgcatgcgcgcacgggtccgctacgcatttccgggcggcctagcgagcgcccgcgcggccggcgggcatgtccggcggggatgcagcgtgcggctcggcctactggccgcgcggagccgccggcggtcggcggtctaacgcttggagtcgcgccccccccccccccccgatcagacgcaaggctttttcaggcgcccgtctcggtcacttaggacagccgcggttcgtctcgaaaaaggtctgcggcgtgggtggtgggggaaagggggaggggcagaacagtccagagaccgtcacgggcgaacgattggggtccgcggggggcgcgaggtggactcggtagccgccgcggtccgatccggaaaccgtgtcccccctgcgctttcttcgggcccgctcgccgacgcgaatggggtgggggaggggggtgcgcgggcgaacaattagggaccgcggagtgcgacagcgggcctcggtagccgccgcggtccgatccggaaaccctgtcccgctgccgctttcctcgggcccgctcgccgactcgatcagaaacccgtctcccccgccatttttatgtctcccgtatgcgcgctcgttcccgccactttctggtgccgctgcggaagaggatagccgggcgggcgagcgggcgagcgcgccgcggaccgaaccgctccgcgggctgcgcaggggaccgcagagattgctcccgcgcgagggatcgatccgcggggtagagggctctccgcgaacagcgtaagaacagaggtgtccccgcgcgccgctgcctccggacgcaccccccgcccccccccccccggccacccagggcgaccgaaaccccctgccgccgccggcaagagtcggtcagagagcgcgaatgatgtctgtcgcatctggtcccttcattcattcattcattcattcattcattcattcattcatttatttatttatttattcgccagcgctacatctcaatcccagctaccgttaaccctaccaccacccccccccccccccccgaccttgagcggttctatccgttcgagatgaccttcacggagcggagctcgttgcaggatccggaggagcggtttccgcagccctagggatcgcgattcttcggtacagccgcgcaggccttcggaaaggacgcggcgatctgagtccagggggccacggctccgcgcccgcggtttcggttcccgggcagaccgccgtcggggacccccgggagctttcggagaaggtagggcggagttctgaggcttgagggacaatgagcggcgggtcggttcggttcacgtcgccgtcgggatccggtgcggccccgtccgactttgccgtgggaggctccattgtccgtcccctcccccctttggcggagcgcagggcgaaaggaccccgctttcgccgccgctcctcctcgtacaggccacgggtcttctaggcgctgtcgccgcgcggtcttccttttacgaaactttctctaccgcgtttgcgggagaacactacggcgaacgcgcccgcgggctcgccggcgcttctgcgctactgaatggccgggcgaaggtgcgcgcggggcattcgttctgggaacaggtatagaggcgtggccacggccgaccaatggaccaggcggtgacgcatccgcacggcagaccgcggcccgtacgactaacagcgcggaacgcaaccgagccgcggggttccgctggccccctaatttatttgtccgtctccccgctcgcggatgatatgtcgtacccgcggggctgcttgtccagatagcccttaaaagtccgccgagtgactccccccgcccccccccccccgaccctgacttagccttcactcgccgaagacttcagagtcgctgagggccaagggcgaaggaggaccgggcagcgtcggaggatgaattatcctctgtcgcgcgccctgttcctcctggacggtggtctccggcggaccgccgtccccttccagccacactacagacgagctacgtaggtgagcgagcatctcgcgggccaataaactgcacgtcgcttcgggaacgtgaacgacgactggctgggcgtgcggatcgggggggaggactacggagcggcaaacgtcgcagacggtcctatttaagaaatcgggggaaactatggcgttctttttgggctccaagacgtacacgggacgcagcggggcgtacagtccccacttgagagcggctcggtgggagtgcgactctccagctaaaaagtcggggccgggcggcctctggcgcccggccacaagggccgaggaggctgcgaggtaggagagagcggtcattgggaccgtcgcgacgcggtccagtcgcgtcgcgaccttgtatcggacgttgcttccgcagcacagactgatgtcgccggccgcggggttttcgcggcgaaagtgcgtttccagctcacgtaggaccacggggcccagcacgtcccgcgaggttatgaccgtcgtagctagatcggggtggccaggccatcggacggagcattggctgcggggcgagacggtgcacctgacgtagcggacggcttcttccacgaggcgcgggccgttctccgggcgatcttgatcctctagcgtgtccaggaccacgagccttttttctcgtttcaaacagaggcgttgcaggtgttccaggacgcccgcaaaaccgaggtcctgaggggacaggaacatgacgccggccgcggtcagcgccgaaacgtccggcgccgctctccaccggcccgcccaggcggcgctctccggtaggcagaggcggttggcgagtgcggcgagcaggaaagagagtcctccccggttcgggtcgaaccggggtcccccggggggcgagccgggcgccggtacgcaaaacaggtgctcgcctgggttggccgtgtacaggatgacgagagcgacatcttcaggcgaagcctgctgatgccgcatccaagcggtgcgcgctctgagagagacgacggccgtgcggcacaacactccctcggacgcagcagtgtctgggcttctgctgacgtgcgagggagtgctcgccacgcgagcgatctccgccatggcctccggagaacgcgccaacggctgacgccacagagtcggtatttgggcgaagctggtcagctcgtcgactccttcgcctggacaataggcgtcgaggtgcggggggccggcatagccagcaatcggagttccaatggggggcttcctaaaggcggcgccacgatgccgtcgatcgcctaacgacagggaaccgtccataatgcgcgcggggtcgcgccacggaaagcaacgtgggcgcttgggcgggaaaggcccggcgtcgcggcacgcttcagggggggtggggggccttgtgcagctggcgacaggcggaggtccggcgcctgtccgggaccttcccaaacgcggacgcgggttctcgacggcgttgtccgcgccgtcgagaaccgccgcgggagctgattttctcttccttgactcggctgacgtttgggcgcaaagggcccgcacgggctcgggagaacttgcggggccggggtcgtaacaaggctccgcggagcgcgaccggccctcggacgttccggaagaggccgcgtcggcgtccgcgagaaggcgcgccacgcgttgcagccgtcgggccttctcgcgggatcgtaccggttcgcccctcgacccacattcgcgcaggagcacggaagtaatgtccctcgacccagggcatcgccaaggccgagcggggtctttgctaagcaacgggccgatcgcttccgttatcagggccaccgcattagccgcgagagttcgctcctggcgcccccgaggagccgaaccgttcgcgtaggccgcgtacacggcgctcctgagatcaagcaggtctcggagccacgacccgagcagagcccggcatttttcccactgttcgtggccggcgggtcgagggaagggcccgtcctcgcaagacgacagcatttccgcgaccgcgcccggaccgtcgggtccgcgcagaagcgccgccacgaccccctcgcactccagcgcgcaagcgtccaccagctcgttcagcggccgggtagacgcgaaaccgtccccggcagggatgtccggacgcgcgggcgcgaccaatcggtattcggggacgtccagcaggccctcctctagcgcggaattgaaggccgcgacgccccggcgcacgcggtcgtggatcgtggacacgtctattaccgggatgagcccggccgccgtactttgggcagtgacgggtgcccgatttgaaataggcgatgccgaggggcgtcgcatttcggcgctggctgcagacgccataggcgcgtaggctttcctgagggagcggaacatgaactctttctgatctttgcagtacctgcgagtcatagacacgctggcggcgatgtgcggtagcgcccaaagcagatttcgcttcttcatggcgctggctatgtggggtatgcatttgttgaccgtccccgtgacggccgcgcccggcgaactgtgcgagctctgaaacttcgtgacatagatgtgattgagcgctgcgtcggtgggcgagagcttgccgtggtgtgcccagttcagggggttcgccttcacgtctttgttaagcatggcgcttacgagcgcctcgtactgtttggcgcagttccccatttcctccacgtacaccgggaggggaccgggagtagagaggaatctaacggcggcctgctctacttcagggatgccccggagcgcctgtcggtgtccgccgagaggcccgaaccagcaccggccggccggcggggagggaatttgccaccacacctcttggtcgaggtcatccggcggtggcggcgcagcagtttccgaggacggtgatggcgcccgccggccgcggccgcgccgtcctccgcggccgcggccgcggcctctggcagcgcattgaggcgctcctgcctcgcgggtcggcgacctggatgaggtgcgcgaagaaggggcggcagacgactgttccgatgaagagggcgcggacgacgaagaggacgaggaagaggaagcggacgaggaggaggaagatctggagcgacacccgagcgaagggtacgaggccgggggaggccggggtaggggatgggaagcgcgggtcgccggcgtgccaacctcctgttgtaatgcctgttttagaacagcaggtggagctgttgtgtgcgaaccatcggagcccgatcccggctggactctgcggtaacgttcctgcgtaccggtggggctgctaacgaggcccggcctcggagacggcccgttccagtctggaacgggaagggggggaaacatgggcgctccgtcgtccctcgcgccggacggctgacggaggtgtctgaatcggcgtagcgccgcggcggtgacggcggcgcgccaatcaagtatggctttgtacagaggtctgacccgtttttcgatggccggaccgcaggcggggaaccccagttcgaccatagcgacggcgagctgctgcaccatgaatccgtaggcgcgtgcgggacgagagccgtggggcgtcccgccgggttccggatttccgttccgcagcgccaacttcgattccctgacggccgcggaaagcgcgggagggagcgcggtggcgggcggggggggcatttcgaaaggcacctcgaagccgggccgcacgtcggggccgacgatgtagtcgtctggggccagcagtaacccccgacgcactttgaaaaaaagacacctgtaatgtagcatcttgaaatcgttccaggtgagcccggtccaggggttcgggctgccttcccggccttccacccaccgaatctcctcgagcagaggacagaagttggaggcatagaagccgccgcggcgccggctgcagtcgagaccgcggggggattcagagggcggcgttccgttccagtcctcgtccaagggagtacccgcgcccggcggcggcgcgcacgccggaaagcacggcagaccacgagccgcttgtaattgataggaaaagtcgcgtgtcagaacgtgggccatgtactggacgcgcctgacgcagcggagtcggtccagccagcggtatgaaaggcggggaaccttcgacacgaaatcgggggtgacttgaaggccgaggaagcgaaggagcgccgacaaaatgtaagcgtacgtcggggtgcgcggagccggtctcgggagccgtgttaccgcttcccagatgcgcgttggcagcactatcggggcggggagggggagcgggcactcgttctgcgggccccatccgcaaccctgcgattctaacacgctttccccgtcctcggacggcgacatatcgtccagggtcgagagaacgaggcgcgcgcatcgagaaaacaaccacatcttgcaggccgcccagtcattccccagctcgttcggagggcacgggaagaccggctcctggggcagcgggcgacccttcgcgcaacgccattcgaacggccggtagtcgctgtcgagtaaaggggcctctctcggcagttcgatagaccccggtgaggtccgcagagggctgccgcgcggagtaggtaagatttctctgagtaccgcttccctcgccagccgatcccagtaggaagggcaccggcgagcgtccgacaacgcgaggagaaaaaccttagggttgtctccggaggacggctccgtcgcgccgtcgcgagcccccgcgcgccacaacatagcgtggctccccggctggcgggccaccaactcgagctcttctcgagggggggatgggatcctggcggatgcggataggcggcagacgtactggaagcccgcgcccctggtacgggggcccccgccctcggaaacgctcgatttacggcgggctgggactcggtcgctccggaggggagcgggtgcgaggcggggggctgaaggggacaacggaggggaaggacgctgacaagaagcagagagggctggggggtccggggaaagaggcctgtcgtggagaggggttggcggaggtggggtagacgccggaggcgagtcaagcggtagagacgcagacggggaggatgtctgcgtagagggaggggaggtagacggcagaggcgtggggggaggggaaccgtgcggagggggggtatgcggaggtggcgtaggaggaggggggctaaggggaggtggcgtaggaggaggggggctaagggggggtggcgtaggaggaggggggctaaggggaggtggtgtagggggagtgggtgaatggtgttgagcgaacggtcccggcgtcagcggagaaaatgtccatgggaagttcacgataggttcgggggggggtggggggggcacgcccgagggaggggggagagtttcgacacagacggcgagcggcgtgcaggcgccggtgggcttacagggcgcgtcagatacgcagcggacggggtcgtttgatttgcggggatccatagggctcggttcgccccgttccgaacccgcggggactagatcgccgactgtcttttgccaagaacaggaccgcggggccgccgcggccgtttcgtttccacagacgtccacgatgtccgcggtggaactgacgacctcgccaggagacccctgatgcgcgccgtcggggggttcggcggaacggagacccgtatccgaaccctccgaaacggcaccctcaatgccgaaaggggctcgtgcgccggcaaggctgcccgcgacgggagccgcgcgggcaggggatttagaccgtggcgggacgggctgccgaccgggcgtcgggggcacggccacgctcggtgtattcaagcacacgtcctggtacggatctcccggggtggcgggtggctgcggagaaaatccgccgttgtcggctaacatctctaacaggctgtagaaatcgggcgggttctccatgtccgagcaatgggggaaacgcgcgccggtccaaccgtggcgacgccggcagcactggcgatccgctccttacaggggcgtaaatgcaggggttaatcgggcggatggggaccagcgcagggagcgcggaaggagtcctgctctgaaaaaaatgagggggaaccgtgagaaagcgttccccgcagttcgcatcgcttcttgccccccgcccaacaccaccaccaccccgcccctacacacaccacagccacggctccggcagtgccggcctggctactcctttaatcattaactcccatcaacgcgatttgatccccgggctgctctccgaatcagccgagccccataggtaaacattccgccgcccacaacgtttcttgtcaaacaaacgcttatcggccggattgcgaaacgagcaggttttgccattagatatgctgcggtcagcgctgctaggctccccgggggcaaacattctcctagcgacgccgaggtaaggagacattaaccctcgacacgctcctgcgagcgactgtgcggttcgtgcggtttgtttctctcgctcccgacgttcctaccgccctcgggagagtgctcgcccgggggctagaacccgaagcggaccggcccttgagcatcgagacgcttaggctcgggcgaaccgcccggctctaaaaagtcaagcgcgcgcgtgtatttcttttttttgggggggggggggggggtggtggtggtggttggagacagaagaggagagaaacggagggggtggtggtggttggagacagaagaggagagaaacggagggggtggtggtggttggagacagaagaggagagaaacggagggggcggtggtggttggagacagaagaggagagaaatggagggggtggtggtgggagagaaataccgacggccggacagagcgaattattaagcacccaacgctcacgccaacacgtcccacctctttccccgacccgcgccgccccccccccccccgatattcgcgtcgggggtcagggacaaagagaggcgacggggcaataggcgctgcgtgggggagggggggccggccctacttgcccctaacgcaccggcgtccacgcgatcgcgcgacccgacagcacctaccaggagcgcggtgccggcggcagccccttctcgattcggctcggagctagccgggagagacggccgcggtcacgtctccctttccgaacgcctagcgatatagttacagaccgaagcgagccgtgtcacaccaagtcacttagccgcaattctgttccccttcccccacacacataacaggagacatagcgcatgggaggggctttccttatctctcgagcagaggtcgccgacacgtcaacgaagggcggtacgtgtgtggtaagtagcagagatcggagttggtcccgatttactaacatctaataccgatcgttcatagccgcctggaatttgcgggcataacccgcggataacggtactggtcagggaagcaacgcagcgcagacacgacccgatataaaagactgcaaacgaggttttgtaggggtaatgagatgatgtggaaaagaaatgggtcagggggcgctgtttgttgtgacacatttgcgcctagtgtgggaccggggcgtgcggcgagcacccagcgcggaacgactcgcaagctgacggtgcagggctaactcgcattagaggaagtgtttgctgatttcttcgtagacgctctgcgccgagagcgtctcctcgtttaacctttatgaagaaggaagtcgctcccatctggtgcggaacgatggggtacttctctccgtaatggggaaccgaaaactgaaccaaatacagaaattagaagaggaacatcggcttttcccgttatgtaaaaggaccatggggtcgcgtccgggaggagggggagagtttggggaactcggggccctaagagcgctacaccagactcttcataataccatatgtcaaggcagttgcggtaaatatagcgacgaccgcaaccgaacgggtatttcttctacaggttagaaccatcccatgacccatgcgaaaagtgttacggcacagagaaggccagagggaaactccgcgtccggcaaagcgcacggtaagacactcgcgaggttgtgcaacagcgcatcgccccgggtagaaccgacaggtttatcttcagatggctatcgcggacaactcgtcgtcggggctgggggaggggggggtatgtgtcagccacttccatcctcgtcgctgtcgtcgctcgcaaatgtgggctatcaacgcttctcgattaaaaaaagacaaactagaggggcatccgcaataaacgacaatgtttcatcacaaaacaaatggcgtggtctattctttttcgtttgcctctgatcctgggcggtccgtactgcggggtgatagataaaagaagacaacagcagggaatcgaggtggcgagctcacaaattgcgaagctcagcctatgccggcgatgatggccgatgagggaatgtaggaagagagggcgtatccccgattgacgatggtgcgaccaccaaccgagtccgtgtactcctatcttccattctcacgacaccggacatgagaaacgatgcgcggagcaagtcgggggggggggggggaatgaatccacggcacgcgcagcgcttcctttacattgcaccacgtgaccatattcccataatgacggcaggcgttatctatataatgccaggcagaagtcttacttccgctcgcgatcactattgtcgtcacacggggagtctgactaggcggtatggacggcgtacgagacagagtattacctgatacgtcaacggacaacgagatctaccttgggtcggggtatccggtgcaattacatgatgaatatgggcaaatttctctaggctcgccggtcgaaagcagcaatagcacaggaaatttttgtgctccgccatggatgccggatatccctcgtttaagtaatgatacatgtaagatatttcggtgtctgactagctgtcgtctcaattgcgcaccgttccacgatgctctcagaagagccttgctcgatatgcacatgttaggtcgaatgggattccgtctacgacagcacgaatgggaacgtatcatgcagttgactccagatgagagcattaacctgcggagaactctcctggaagccgacgagcggagcagtcattgtatgccgaacgtgtacgcatctgacattagtaattccctcgaagctggtacaatgcaagttacctccagctccaatatccggggtatcagcaacaagtccgtaaatcactgattacaaaactcactgatgtagacgaacaataaatgtcctattgccagtaatcactttgcctgttatttattgaatgagtatgtcgcgttaattaagtaacgcagtgtgggcgtgacttgtaccatatagatttctattgactacaacgttatccgacctgacatttgggagctgggtgtctatagagacagaaggtgcaccaccgcgcaagataatattgtgatatgtccagtgaggtatgtgaagtaccatcaccgcaaaagcaaatgggcctgtggtcggtgtgccgcaaacttcgcagaacatctcatctgtggccggatcctgcgaatgagaaagtatacggtatactttctgctggtggagtacatatatcatccctgccaaagtctgtacgcggtttggcccgaactgtattgaccgctgccatggtctctttcgcggcaatgaaagctggtatgccgccatccattcacctgtggcgtgagataatggatttaactgacgcaacaatccgccgcgaacaacggtccacatcaaatttctacgtagccggttcgttgaggaaaatagtaagtgttgcattgcgaaattataagcatgcacctgaaacgcatggagaaatggatagccgtctgactgctattatgtattggtgttgtcttgggcatcctggctgctgtattgtttcccatttatatgaggaaaacagtgatctgattaagttgttgggaatggcaacaggctgtggagaaagcccgcttactgaagtagagtcttattggaagcctttatgccgggctgtagcagcgaaggggaatgcattaatttacgacgacgtcgaagtggcacattacctgatcaacgtgcgacaatcgtctgaatcttcgcctccagacgatggggaagacattgagtaaatttgcgcgaatgacagggctcggaaacaatgtatagagttttgcaaataaacactttattgacttaccagaagttattgcatcttattgtaatctgcgtcaatattctctaacttcagttaaaacgtagcaatcgcagaggggcaaactagagaaaaatggacccgcgacctaaatctcgtctaaaacgctccagtgctttacagttcgataatctggacctggggacgcgtataggatcgttcctccacatgcgctgctgtcggtatctcgaatccccggtattcagttgaatcgttggcggagtgtcctcctggactctgcaatgttccctagccgtcttcactatctcgtgcaaggctctataatacagttcctctgcagacccgtcgttgctcttcccttctgcgtcgttagttatttctgtaggctccagacgatttgcctgcatttgtgcgcaacataatctgattgcattccctatctcgtcttccggtaatcccataggtgttcggtattcgcagataggtagagaaagcaccactgcaaatcgtgcaatttccattgccccaaccaatattttttttaagaacggcatcgccgttaatgtacctcgggcattgtgacgatcgaaacccttatggatgcctaaagagagcattgcggtccagttctccaggtgaaaagagaatagcgcgggtagaaacgggccgattagttttatcttcgccgcgtccctaatatcccaagttctgcagtataacttccatcgtccgttttcgacaaggtccggcgcgacatagtttgaaatgtcatctatcagaaacatctcgcccatcgtagaaaaaaacctgtacgcagaccataaaaccattcggtaccacatatccttgtgtatatcaaacgatatgttggttatgtcgttggcggatgttgtatgaaatagagctaagcgttctctggattccacgcactgaacgattccgttagtcaattcatctgctaacataggccaaaagtttattcgtgttacttttctcggcggtttggcaaaacgcccccttggcacatccatgtcattaaatacagcggcataactcctactcatgtgttccatagcccaggtttctgttcggtctgctactacgatcagatcagtggcgcgatcagatgcgtgggatgaatgaagtgtatccgaaagcagttttgagatatacgctaaactgtacgacgattgtggcactaaacgaagctttgcgcgacccccatcccacgcggagtctgtgcaaggttaatgaccctcgcagttcattcggaagttataactgccgccttcgcacatttctttttgtcctgttttgtattgccataacagataggaattgaaacctgatcctcctgttttttgcagcatggccagcaacagaatactttgtcggatcgactacttgcgcgagatggttccgttcttggaggtttcggcgggtcgggtggagaacctattattttatacacacacgtcataccgttgtcgcgaaaatgttctttgtcttctgccgtctcgaacgtcggttcccacgtagacgttaggagcgttggaatggtatcaggaagagcccacggcatgccggaccaagtacccgctactttgaccgcgagcagtctcttcggtaatgggatgtattccagagcagcgcggcagagatcagcggcccccactatccacagactgtatgaagtgttttctgaaacatcggactccaacatcaaatatccagacataacatcttgccattcggaagcacatccgccgacatcttcaaatagcctaactataaacgagtctctagttcctgctaacccagtacctcgaatgccagtcccatccggtgggttcgtcctgataatcggtctctgacgccgaggaagaactaaaaggggtctggaaaagcggaacagatctgcagaccgaacgactacagacacgcccacatcatcatgtatctgttccatgcattgctttatgagaaaaatccataaggccgaggcggcatctctagatctcccggggagtctctcgcactcatctaggagagtgacgacagttatcatagacacgcccatttgtgcaccaaacgaaaagttcctgtactggtggagcgtcggcgcgggaatcggtccgtgctctgaaaccagtgtctagacagaagaccatccggtaaattctggtgtatgaactgacggtctccagacgaacgtcgaagacattaacgatggaaactaacgagctttcttcaaaagtgtctgattacaacgctaatagaccttacgaaactatacgcagcgataccagtgacacagatccgtcggtgtcgtgtgggactctctccgacaaagacggggacgacgaagaatctatagatttaagcaaggtcccgaatgcaacgaatgtcggcgcaggtgaagattgcacatcccccaacgacgggcgcacagagttatgccgtacgacttcggttaccggaccggcctcggtcgtgaggatgcaatacaatattatttcaccattaccgcccagctcggagggccgcgtattcgtctgtacccgttgggacgatgtcagcaataagaaggtgattgttaaagtcgtcaccggaggtagagacccagggagagaaatcgagatcgtaaagacactttcccattgcgcgattatacagctaattcatgcatatagttggaaatctacggtatgtatggtaatgcctaagtataaatgcgatctgtttacctatgtggatagaaaggaatcaatacctttgaaagacgttattgtcattgaacgacgtttgttggaagctctggtttatctgcacggcaaaggtgtaattcatcgcgatgtaaagacagaaaacatatttctggactaccccggaaacgctgttttgggagatttcggggcagcgtgcaaattagacatgcatgataatagtcccaagtgctatggttgggccggaactatggaaacaaattccccagagctcctcgcgctagatccttattgtgccaaaacagatatctggagtgccgggcttgtgttattcgagatgtctgccaaaaaaaggacactgtttggaaaacaagtaaaaacctccagttctcaactgagagcattgattagatgtttgcagatccacgctttagaatttccacaggatgaatccacgactctatgcaaacaattcaaacaatatgcaatcccactgcggcctcctttctccattccagaagttgtaagaagaaatatcccgtcaatggatgttgagtatacaattgcaaaaatgctcacatttgatcaagagtttagaccttcggctcaagacatcctggcgttccccctctttgtgaaagaagccccccaaaatctccaggccctatttgttccctgagtgctaacagcacatgcaatcgaatcccattagaagccgtgctatttaaattttaatgtcgcatagaaatatatggtatacggcgccacgcagagctctatacggcttccactttagaagccaatgttttgtcatcagtgagtaatacgacttgggttacaagagacaaacataatacgtcgaacttaacaaatgccggaatctgtacccgttttctcatcgccgctgctgcatattaacggcaggaagcccttaggtatagcctgagcgtttttacgtccactgcattgccatattcgctacatcacgtatttctacaagaagatgagagtgtctattcaacgggcaattttcctgatatacatatgtacagtctccatgtccagctcggaaaaaactcgtaatgaggacgcctctcgtattagttcttcggacacctttcgcctaaaagaattccccgtatctgcgataccatcgcctctactcgacgtagtcgataactcgtacccgacgaaacacgtcatatacactgacacttgcggtttcgctgttttgaatcccaccggcgatccgaaatacacaatcctcagcttacttttgatgggacgacatagatacgatgctactgttgcatggtacgtcctgggtaagacatgtgctagaccaatttatctacgcgtattttcagattgtcatacaaatgaacaatttgggatgtgcacttcaaaatctccgggatggtgggatattggttatgcaaaaactgcgtatattgaccgtgatgagttgacgttagtattagctgctcctgctccagagttgggtgggctatacacacgtttaatcataattaatggcgagccaatatctagtgacatacttctaacgattgaggggacgtgtagtttttcgctcaaaggcccaatcgacgaccggctctgtaaaccattcaacttttttgtaaatgggaccacgcttgacataggcatgtttcctgcacgaactccccgaccccatgaagaaaacgtaaaacagtggcttacgcgccaaagcggaaaactggatacggttattggtgaagcgtccatgcgtcatgcagcagatttgccacgtgcttttagagattcgtatttgaaatcgcctaaagataacctacctgacgaccctggaaggcctacagtttcaattagcagtatccatgccaatgatgcctatgtaggaagcacctctctgtatgaccaatcgctacgcgcaactgaagagccagtattgccatctgtagatgaggcccgtcctgcgctttatacaaatgcagagaggaaccccaggatgcaactaataatttctgccattgttgttgctagtactgtaatggtcgcactgattgggataagtgcatgtattgttaggaaatgctgtaaaaggaaaatcaaaagagggatacctcaacgcccgtccaggaaagtgtattcccgcctatgattacgtatggacttgggcgtgtcgacacagacacaaaacccagtttgcggccttcttgaaactatcgatgtaatgtctctgtcgaacgggcacatggcacattggagtgcggcgtccaaaaaacatatactatgtttcctatttcttgtcacggggagccattctctaatcttcaccgggacttcgttatccgcatcgacggatcaatcggccatcgttgccttctgtggactcgacaaaacggtgaatgtttacggtagacttttcttcttgggtgactcggttggtgttatttcttacgatggaacgacagaaattctgagatggaacgaaaaactaaagtgtttctcggtcatgtatgccgcgttgtatacggactgcccccttgcagggtctgctttatttagaggatgtagaagcgcggtggtgtatgctacccctcatgacagggtgaagccggtttccgaaaaaggattactgctgtgcatttcagatcccagaatttctgacaccggtacatattacatccgcgtgtccctcgccggcagaaatgtcagtgatattttcagaattgacgtcgttgtgacgagtagcagtattcatacatgcggccatgcggataaaggtatacaggaatgtattaggtatgccgaccgtgtgtcattcgagaactatctaattggacacgtgggacaattgctgcctgtcgactcagagctacacgccgtgtataatgtcactcccagatcggtcgttgggacaaatactgataccatgtcagcttttactaattcgacaacaaaatctgcttcgacgaatttaatcgctatgaagactactcatccaccaagtacgcggcgctgtaacttgaggcgtgcccttccaaaattaatatacatgtcttcattggcaggcctgtgccttctcgtactattaattggtagagcggttgtaaagtgcaaaacgcccaaacccaaaatctacaagggcgactccacctctgacggcatctcgcttatcaattctgcagtaaacgacgcatttgggtgtaatcctgcaaaagaggttgatccctcgaatatttctgaaggcgagaagctggaaaacatgcagaaaacgaccggaaatgtagaaaagtaaccgtgcgagttatgagctggaatggacgttacatgcgggaagaagtagggcgtaactaagtacatgttagaaggggaggggcgggttttgacttttaaaagcacaccgcgggaccacggcggaattatgcttgatatacccgggctacgtggcataatgtcttgtccgcgaatgccccttttcctaatggcggcgatgatgtgcagtgcaaccaccgtaaatcgtatactaattccccaggggaattcggcaacacttaagatctccagatatccgccggttgtagatgggactccatatacagagacgtggacatggatctctaatcgctgcaacgaaacggcgactggatacgtatgtttggacagcgttaattgttttcatgacttaatcgttaaaatggcctgttggcggtattccaaagaggtaatactgcgcactgccagattcgtggtagagaggggcgtgttaaaaacgatagagaccgctaagctgcgcaacgctccgcgtgtattgattgtggacaacgtggacactcaatggactgttttgaatgcgagcgagcaaaacgcgggcatttatattcgatattcccgaaatggaacgagaaccgctcacgtagatgccatagtccttgccgtttctggtcgaaagagaggcagggtgccaccgacagtttatcctgttggaccatttttgcacaaattccaaatctcccttaaaaattttaaaacgttcttatatcaggtgggggataccgttacaatatcgataactacacgcctggagacgacggttcgtgcgttcaagttggagtttcgggtaatgtttctcccctacagtccaaactgtaagtcgttcactatttacgagccgtgtattttccaccccaaagagccagagtgcatatctccgtcggagctatcggaatgtcggtttgcatcaaacgcgcaggtcctggaaattgccgccgcacgctcggtgaactgcagcgcgggccgcgcgtgccattacgatgccgaggtcgacgaatcgatgcagcaaaggttcgcattcctttattcggaaatcccctcgtttacaattggcaatgccgggccgggggacgcgggtctgtacgtcgtcgtcgctctgtgcgatgagcggccgacaacttggactcacgtctatctatcgaccttggacaagatcctagatgtgcacgagatcgctcacaagccgggatttgatgacagagtcttatcgagcaatgacgacgccgctcgcggtgtaagacccggagcggccatcgagaaagaatcaggtaggctccgtctaagcggagccctaattgcatcgatcgtgctggtggccgcggccgtcgtaactacggtaagcttttgcggagcttgcgtcttccggtggcgtcgcaggtgccaccggaagacgcaagctcccggcaactcttgcaagtacatgtcgttgccccaaaatcattgggaagagttttacgacgacgttagggttggcagcgcccctcagtatgagcagtttaaccaaaggttgcccgagagaacgagatcaggctacaccgcttggctctcgtctgatatagccgccgtaagaaagcgtctcgattgaaatcgccgagacgtgcgtgccgattgttgtttttattgtatcgcccgtacttaacggtcctttatccccgcgcgaaataaaactgtccgactcagtctactggtgctcgcgtttacctccactgcgtaccgcgcgccaattttcgtgtaggtgtgcgtatggtggagtggtttgggggaccctgtctctaagccggcacactccacgctatttccccccgcccggtgggcacaagcgcttgcgggaggaaccagttgtcggttttttatgcgggctcctcagcaccttcgccacccacccacactccgcgccccgactgcgcgaagctgccccgtttaggcaaacggggcccggccggcgcgacgcagaagaataaagcagactccgtcgtttcttctataatggagggtatactcgtttattgcgacatcacaccccgtgttgctattttaaattgaaggccgttgataacccgcatcatccactaacgtcgttagcgataacgattgtatcttcccccccccccccacctacggtttgtcgacagctatgataagcggaggaaaacctgcctgattccttgggcggggatccttgtgcgctgtcttgctctgtatgcgccgacccaaagccgcctcctcctcaacgtaaatttaaccgcccaggccgcgtagttgcgtgtcctgaacgggaaagaagttcgttcgctgttattgtggtcattaccgtaactgtcccggcgtgcctccatctgctgagtcccgtgcagactggcatgaggatggttgttcggcggcaggcaactcccccctcatccctactaatcccgaatgcctttaatgatcacgcaataacccctcctcttaacaatatctctttttcgatgaagatttcagttcccccataacacggcagaacgagtctgatccctgatcaattggaacgacttccttcttcagaaaggttaaacgaggacacagtctgcgacgagagggcttaacacttcctcctgtgcgagagcgcgtctctgcgatgtggcttcgccgcaaagtcctttcccatactaggcgtaaaccgcactataacaactccccctccccccagcacccaaggggcccgtgaaaccgcgactggtttcttcttcactggctcagtactgcaaatgtgctgcttacctcgtgattgctgtcgtcggggctcgttcgcactttccaggccaccaaagaaagcgagaccagagccaatcgggaccatctccgaaccttgttcgctaccacacacgtgccgccctttgttgacgtggccgcaaacagagctcgtggccacgccaacgaactgctcgtcctataaaacccctcccatactcaatgccccctgaaatgtttgcaggggggaaagtgaagccttctgcttcattcaggtgttcgcaatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacaggaaagggagacgtgaccgcggccgtctctcccggctagctccgagccgaatcgagaaggggctgccgccggcaccgcgctcctggtaggtgctgtcgggtcgcgcgatcgcgtggacgccggtgcgttaggggcaagtagggccggccccccctcccccacgcagcgcctattgccccgtcgcctctctttgtccctgaccccgacgcgaatatcggggggggggggggcggcgcgggtcggggaaagaggtgggacgtgttggcgtgagcgttgggtgcttaataattcgctctgtccggccgtcggtatttctctcccaccaccaccccctccatttctctcctcttctgtctccaaccaccaccgccccctccgtttctctcctcttctgtctccaaccaccaccaccccctccgtttctctcctcttctgtctccaaccaccaccaccccctccgtttctctcctcttctgtctccaaccaccaccaccacccccccccccccccccaaaaaaaagaaatacacgcgcgcgcttgactttttagagccgggcggttcgcccgagcctaagcgtctcgatgctcaagggccggtccgcttcgggttctagcccccgggcgagcactctcccgagggcggtaggaacgtcgggagcgagagaaacaaaccgcacgaaccgcacagtcgctcgcaggagcgtgtcgagggttaatgtctccttacctcggcgtcgctaggagaatgtttgcccccggggagcctagcagcgctgaccgcagcatatctaatggcaaaacctgctcgtttcgcaatccggccgataagcgtttgtttgacaagaaacgttgtgggcggcggaatgtttacctatggggctcggctgattcggagagcagcccggggatcaaatcgcgttgatgggagttaatgattaaaggagtagccaggccggcactgccggagccgtggctgtggtgtgtgtaggggcggggtggtggtggtgttgggcggggggcaagaagcgatgcgaactgcggggaacgctttctcacggttccccctcatttttttcagagcaggactccttccgcgctccctgcgctggtccccatccgcccgattaacccctgcatttacgcccctgtaaggagcggatcgccagtgctgccggcgtcgccacggttggaccggcgcgcgtttcccccattgctcggacatggagaacccgcccgatttctacagcctgttagagatgttagccgacaacggcggattttctccgcagccacccgccaccccgggagatccgtaccaggacgtgtgcttgaatacaccgagcgtggccgtgcccccgacgcccggtcggcagcccgtcccgccacggtctaaatcccctgcccgcgcggctcccgtcgcgggcagccttgccggcgcacgagcccctttcggcattgagggtgccgtttcggagggttcggatacgggtctccgttccgccgaaccccccgacggcgcgcatcaggggtctcctggcgaggtcgtcagttccaccgcggacatcgtggacgtctgtggaaacgaaacggccgcggcggccccgcggtcctgttcttggcaaaagacagtcggcgatctagtccccgcgggttcggaacggggcgaaccgagccctatggatccccgcaaatcaaacgaccccgtccgctgcgtatctgacgcgccctgtaagcccaccggcgcctgcacgccgctcgccgtctgtgtcgaaactctcccccctccctcgggcgtgccccccccacccccccccgaacctatcgtgaacttcccatggacattttctccgctgacgccgggaccgttcgctcaacaccattcacccactccccctacaccacctccccttagcccccctcctcctacgccacccccccttagcccccctcctcctacgccacctccccttagcccccctcctcctacgccacctccgcataccccccctccgcacggttcccctccccccacgcctctgccgtctacctcccctccctctacgcagacatcctccccgtctgcgtctctaccgcttgactcgcctccggcgtctaccccacctccgccaacccctctccacgacaggcctctttccccggaccccccagccctctctgcttcttgtcagcgtccttcccctccgttgtccccttcagccccccgcctcgcacccgctcccctccggagcgaccgagtcccagcccgccgtaaatcgagcgtttccgagggcgggggcccccgtaccaggggcgcgggcttccagtacgtctgccgcctatccgcatccgccaggatcccatccccccctcgagaagagctcgagttggtggcccgccagccggggagccacgctatgttgtggcgcgcgggggctcgcgacggcgcgacggagccgtcctccggagacaaccctaaggtttttctcctcgcgttgtcggacgctcgccggtgcccttcctactgggatcggctggcgagggaagcggtactcagagaaatcttacctactccgcgcggcagccctctgcggacctcaccggggtctatcgaactgccgagagaggcccctttactcgacagcgactaccggccgttcgaatggcgttgcgcgaagggtcgcccgctgccccaggagccggtcttcccgtgccctccgaacgagctggggaatgactgggcggcctgcaagatgtggttgttttctcgatgcgcgcgcctcgttctctcgaccctggacgatatgtcgccgtccgaggacggggaaagcgtgttagaatcgcagggttgcggatggggcccgcagaacgagtgcccgctccccctccccgccccgatagtgctgccaacgcgcatctgggaagcggtaacacggctcccgagaccggctccgcgcaccccgacgtacgcttacattttgtcggcgctccttcgcttcctcggccttcaagtcacccccgatttcgtgtcgaaggttccccgcctttcataccgctggctggaccgactccgctgcgtcaggcgcgtccagtacatggcccacgttctgacacgcgacttttcctatcaattacaagcggctcgtggtctgccgtgctttccggcgtgcgcgccgccgccgggcgcgggtactcccttggacgaggactggaacggaacgccgccctctgaatccccccgcggtctcgactgcagccggcgccgcggcggcttctatgcctccaacttctgtcctctgctcgaggagattcggtgggtggaaggccgggaaggcagcccgaacccctggaccgggctcacctggaacgatttcaagatgctacattacaggtgtctttttttcaaagtgcgtcgggggttactgctggccccagacgactacatcgtcggccccgacgtgcggcccggcttcgaggtgcctttcgaaatgccccccccgcccgccaccgcgctccctcccgcgctttccgcggccgtcagggaatcgaagttggcgctgcggaacggaaatccggaacccggcgggacgccccacggctctcgtcccgcacgcgcctacggattcatggtgcagcagctcgccgtcgctatggtcgaactggggttccccgcctgcggtccggccatcgaaaaacgggtcagacctctgtacaaagccatacttgattggcgcgccgccgtcaccgccgcggcgctacgccgattcagacacctccgtcagccgtccggcgcgagggacgacggagcgcccatgtttcccccccttcccgttccagactggaacgggccgtctccgaggccgggcctcgttagcagccccaccggtacgcaggaacgttaccgcagagtccagccgggatcgggctccgatggttcgcacacaacagctccacctgctgttctaaaacaggcattacaacaggaggttggcacgccggcgacccgcgcttcccatcccctaccccggcctcccccggcctcgtacccttcgctcgggtgtcgctccagatcttcctcctcctcgtccgcttcctcttcctcgtcctcttcgtcgtccgcgccctcttcatcggaacagtcgtctgccgccccttcttcgcgcacctcatccaggtcgccgacccgcgaggcaggagcgcctcaatgcgctgccagaggccgcggccgcggccgcggaggacggcgcggccgcggccggcgggcgccatcaccgtcctcggaaactgctgcgccgccaccgccggatgacctcgaccaagaggtgtggtggcaaattccctccccgccggccggccggtgctggttcgggcctctcggcggacaccgacaggcgctccggggcatccctgaagtagagcaggccgccgttagattcctctctactcccggtcccctcccggtgtacgtggaggaaatggggaactgcgccaaacagtacgaggcgctcgtaagcgccatgcttaacaaagacgtgaaggcgaaccccctgaactgggcacaccacggcaagctctcgcccaccgacgcagcgctcaatcacatctatgtcacgaagtttcagagctcgcacagttcgccgggcgcggccgtcacggggacggtcaacaaatgcataccccacatagccagcgccatgaagaagcgaaatctgctttgggcgctaccgcacatcgccgccagcgtgtctatgactcgcaggtactgcaaagatcagaaagagttcatgttccgctccctcaggaaagcctacgcgcctatggcgtctgcagccagcgccgaaatgcgacgcccctcggcatcgcctatttcaaatcgggcacccgtcactgcccaaagtacggcggccgggctcatcccggtaatagacgtgtccacgatccacgaccgcgtgcgccggggcgtcgcggccttcaattccgcgctagaggagggcctgctggacgtccccgaataccgattggtcgcgcccgcgcgtccggacatccctgccggggacggtttcgcgtctacccggccgctgaacgagctggtggacgcttgcgcgctggagtgcgagggggtcgtggcggcgcttctgcgcggacccgacggtccgggcgcggtcgcggaaatgctgtcgtcttgcgaggacgggcccttccctcgacccgccggccacgaacagtgggaaaaatgccgggctctgctcgggtcgtggctccgagacctgcttgatctcaggagcgccgtgtacgcggcctacgcgaacggttcggctcctcgggggcgccaggagcgaactctcgcggctaatgcggtggccctgataacggaagcgatcggcccgttgcttagcaaagaccccgctcggccttggcgatgccctgggtcgagggacattacttccgtgctcctgcgcgaatgtgggtcgaggggcgaaccggtacgatcccgcgagaaggcccgacggctgcaacgcgtggcgcgccttctcgcggacgccgacgcggcctcttccggaacgtccgagggccggtcgcgctccgcggagccttgttacgaccccggccccgcaagttctcccgagcccgtgcgggccctttgcgcccaaacgtcagccgagtcaaggaagagaaaatcagctcccgcggcggttctcgacggcgcggacaacgccgtcgagaacccgcgtccgcgtttgggaaggtcccggacaggcgccggacctccgcctgtcgccagctgcacaaggccccccaccccccctgaagcgtgccgcgacgccgggcctttcccgcccaagcgcccacgttgctttccgtggcgcgaccccgcgcgcattatggacggttccctgtcgttaggcgatcgacggcatcgtggcgccgcctttaggaagccccccattggaactccgattgctggctatgccggccccccgcacctcgacgcctattgtccaggcgaaggagtcgacgagctgaccagcttcgcccaaataccgactctgtggcgtcagccgttggcgcgttctccggaggccatggcggagatcgctcgcgtggcgagcactccctcgcacgtcagcagaagcccagacactgctgcgtccgagggagtgttgtgccgcacggccgtcgtctctctcagagcgcgcaccgcttggatgcggcatcagcaggcttcgcctgaagatgtcgctctcgtcatcctgtacacggccaacccaggcgagcacctgttttgcgtaccggcgcccggctcgccccccgggggaccccggttcgacccgaaccggggaggactctctttcctgctcgccgcactcgccaaccgcctctgcctaccggagagcgccgcctgggcgggccggtggagagcggcgccggacgtttcggcgctgaccgcggccggcgtcatgttcctgtcccctcaggacctcggttttgcgggcgtcctggaacacctgcaacgcctctgtttgaaacgagaaaaaaggctcgtggtcctggacacgctagaggatcaagatcgcccggagaacggcccgcgcctcgtggaagaagccgtccgctacgtcaggtgcaccgtctcgccccgcagccaatgctccgtccgatggcctggccaccccgatctagctacgacggtcataacctcgcgggacgtgctgggccccgtggtcctacgtgagctggaaacgcactttcgccgcgaaaaccccgcggccggcgacatcagtctgtgctgcggaagcaacgtccgatacaaggtcgcgacgcgactggaccgcgtcgcgacggtcccaatgaccgctctctcctacctcgcagcctcctcggcccttgtggccgggcgccagaggccgcccggccccgactttttagctggagagtcgcactcccaccgagccgctctcaagtggggactgtacgccccgctgcgtcccgtgtacgtcttggagcccaaaaagaacgccatagtttcccccgatttcttaaataggaccgtctgcgacgtttgccgctccgtagtcctcccccccgatccgcacgcccagccagtcgtcgttcacgttcccgaagcgacgtgcagtttattggcccgcgagatgctcgctcacctacgtagctcgtctgtagtgtggctggaaggggacggcggtccgccggagaccaccgtccaggaggaacagggcgcgcgacagaggataattcatcctccgacgctgcccggtcctccttcgcccttggccctcagcgactctgaagtcttcggcgagtgaaggctaagtcagggtcgggggggggggggcggggggagtcactcggcggacttttaagggctatctggacaagcagccccgcgggtacgacatatcatccgcgagcggggagacggacaaataaattagggggccagcggaaccccgcggctcggttgcgttccgcgctgttagtcgtacgggccgcggtctgccgtgcggatgcgtcaccgcctggtccattggtcggccgtggccacgcctctatacctgttcccagaacgaatgccccgcgcgcaccttcgcccggccattcagtagcgcagaagcgccggcgagcccgcgggcgcgttcgccgtagtgttctcccgcaaacgcggtagagaaagtttcgtaaaaggaagaccgcgcggcgacagcgcctagaagacccgtggcctgtacgaggaggagcggcggcgaaagcggggtcctttcgccctgcgctccgccaaaggggggaggggacggacaatggagcctcccacggcaaagtcggacggggccgcaccggatcccgacggcgacgtgaaccgaaccgacccgccgctcattgtccctcaagcctcagaactccgccctaccttctccgaaagctcccgggggtccccgacggcggtctgcccgggaaccgaaaccgcgggcgcggagccgtggccccctggactcagatcgccgcgtcctttccgaaggcctgcgcggctgtaccgaagaatcgcgatccctagggctgcggaaaccgctcctccggatcctgcaacgagctccgctccgtgaaggtcatctcgaacggatagaaccgctcaaggtcgggggggggggggggggtggtggtagggttaacggtagctgggattgagatgtagcgctggcgaataaataaataaataaatgaatgaatgaatgaatgaatgaatgaatgaatgaatgaagggaccagatgcgacagacatcattcgcgctctctgaccgactcttgccggcggcggcagggggtttcggtcgccctgggtggccgggggggggggggcggggggtgcgtccggaggcagcggcgcgcggggacacctctgttcttacgctgttcgcggagagccctctaccccgcggatcgatccctcgcgcgggagcaatctctgcggtcccctgcgcagcccgcggagcggttcggtccgcggcgcgctcgcccgctcgcccgcccggctatcctcttccgcagcggcaccagaaagtggcgggaacgagcgcgcatacgggagacataaaaatggcgggggagacgggtttctgatcgagtcggcgagcgggcccgaggaaagcggcagcgggacagggtttccggatcggaccgcggcggctaccgaggcccgctgtcgcactccgcggtccctaattgttcgcccgcgcacccccctcccccaccccattcgcgtcggcgagcgggcccgaagaaagcgcaggggggacacggtttccggatcggaccgcggcggctaccgagtccacctcgcgccccccgcggaccccaatcgttcgcccgtgacggtctctggactgttctgcccctccccctttcccccaccacccacgccgcagacctttttcgagacgaaccgcggctgtcctaagtgaccgagacgggcgcctgaaaaagccttgcgtctgatcggggggggggggggggcgcgactccaagcgttagaccgccgaccgccggcggctccgcgcggccagtaggccgagccgcacgctgcatccccgccggacatgcccgccggccgcgcgggcgctcgctaggccgcccggaaatgcgtagcggacccgtgcgcgcatgcgcgcagtcgacatttgcgagcatgcgcgcggcggaccctagcgagcatgcgcgcggcggaccgtagggagcatgcgcgcggcggaccgtagggagcatgcgcgcggcggaccctggccaccaccaaacgtcataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggct

SEQ ID NO: 2 - DNA, 119 bp, unidentified
  source 1..119: mol_type = other DNA; note = Gallid alphaherpesvirus 3 (GaHV-3) cepa SB-1
acgcgagagaccgagcattagagtagcacttatttattctatcgcagagaaacaccgcgcgcgttcaaaaaaaacacaggcggggtacgataaatttacgcggccgcgctatgtttact

SEQ ID NO: 3 - DNA, 1662 bp, unidentified
  source 1..1662: mol_type = other DNA; note = Gen de la F de NDV cepa NDV/peacock/Peru/2011 genotipo XII (PP2011)
atgggctccaaaccttctaccaggatcttagtacccttgatactgatcactcggattgcattgatactaagctgtatttgcctgacaagctctcttgacggcagatcacttgcagccgcagggattatagtaacaggggataaggcaatcaatatatacacctcatctcagacagggtcaatcatagtcaagttgctcccgaatatgcccaaggataaagaggcatgtgcaagagccccattagaggcatacaacagaacactgacctccttactcaacccccttggcgattctatccgcaggatacaagggtccgcgtccacttctggaggaaggaggcaaaaacgctttataggtgctgttatcggcagtgtagctcttggggttgcaacagcagcgcagataacagcagctgcggccctaatacaagccaaccagaatgccgccaacatcctccggcttaaggagagcattgccgcaaccaatgaagctgtgcatgaggtcaccgacggattgtcacagctagcggtggcagttgggaagatgcagcagttcgtcaatgaccagtttaataatacggcacgagaattggactgtataaaaattacacagcaggtcggtgtagaacttaacctatatctaactgaattgaccacagtattcgggccacaaatcacttcccctgccttaactcaactgaccatccaagcactttataatttagccggtggcaatatggactacttattaactaagttaggtgtaggaaacaatcaactcagctcattaattagtagcggcctgattgttggctaccctatattgtatgactcacagactcaactcctgggcatccaagtgaatttaccctcagtcgggaacctcaacaatatgcgtgccacctacttggagaccctatcagtaagcacaaccaaagggtttgcctcagcacttgtcccgaaggtagtgacacaagtcggttccgtgatagaagaactcgacacctcatattgtatagagtccgatctggatttatattgtacaagaatagtgacattccccatgtctccgggtatctattcttgtttaagtggcaatacgtcagcttgcatgtattcaaagactgagggtgcactcactacaccatatatggccctcaaaggctcagttattgccaattgtaagataaccacatgtagatgcgcagaccctccaggtatcatatcgcaaaattacggagaagctgtatctctgatagacagacattcatgtaacgtcttatcattagacgggataactctgaggctcagtggagagtttgatacaacttatcaaaagaatatctcaatactagattctcaagtcatcgtgacaggcaaccttgacatatcgaccgagcttgggaatgttaataactctatcagcaatgccttggacaagttggcagaaagcaacagcaagctagataaaatcaatgtcagactaaccagcacatctgctctcattacttacatcgttctaactgccatatctcttgtcttcggcacacttagcctggttttagcatgttacttgatgtataaacaaaaagcacagcaaaagactttactgtggcttgggaacaataccctcgatcaaatgagaaccactataagggcatga

SEQ ID NO: 4 - DNA, 171856 bp, unidentified
  source 1..171856: mol_type = other DNA; note = Genoma completo del virus rSB1-GFP-F
ataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggctgggccgcagcctcccgccgccacaggtgcactcagcccgcgggctgccgcaccccgcgaactgtcggctacaggcagaatgaacgcgcagcattgcgcggacacagtgggtgaccgaagcacaccaccacagactctgaccctgccatagccccgaccgtgaaatgaggcccggcgaggcctaacagtcaccccgaccgtgatacatgacaccaacgctgcccgttacattaaaaggtcctagccctacatgccgtaaccgccaaagccgctacccttaatatgtcctgaccccgactatggactattaccctaaccctgaaaggccataacagtgaccctaacagtcctgacgccgaccccgagaggccctaaccgccaccgtaaacggccctggcccaagcccttaatgtggccctaacaggcactaaaacgaataagacaggccctaaccccgaccgtgatgacaggccgaacccccgaccctaacagaccctatcgcggggtccaataatccgctttcccaccccgtccttcaacggaagagtgcgtgcttcagacccgcggacccgggcaacttgtacccggccccgagcgtctctgtgcaacgcactacattgaaagtaaacaacaggtaggcggtgtcgactcaggtctgtgcgaacgccaaccgctttcaagaacggaggctacgcgcagtcacgaatgaggaagtggttttgtgaggccgatcccctttcctgtttttttgagactcgcagccgattccgagaggaccgggagcgcacgacgatgggctcccgccttacagttttctccgcgaacaccgtactcctgctgggaaggtaagccgcggtccactgtttacttcccgtgcaagcacttccgcgtacgcgattgtccggcacgtccggacgcgcttaatttccgtgtcctgactgcatccggcgactacagcgccgcatccccccctcaaccccccccccgtagattccatggccgagtccgccacaccggctttttggaatttcgcggggggctggcggagaccgcctctgtcccggcgctcgggaagtgcgtacaggatgtttttctttttccggcagcggtgcagcaatggcggggacgcaggacgcttgggaaccgcggaccgcagcctttgcgtcgccgccgggagacggcggcttcatcgcgcacgcgggcgctcctagccccgacccgggctgaagccgtcggccagtacgaataaaaacgcccatggaatgctgctacgagacgcgtccgtccgtccgtccgtctggctcgcgcgcgagcgcatgcgcgcacatccgccgtttccgtaaacaccggaacgacaccctcgccggccccgaccctcaatccgcggcacgccctgaccctataaccattacacgccccgccctaattccgagagaccttaacccctaacctaaccctgttaccctacccctaacaggccctaaccctgacggggagggggaacgcctccttaacagactaacaataatggggggggggaggagggtcgctcctagccctaacgggcccaaccttcgcgcctaccctacccctgccaggccctaaccctactcgggggggggaggggggatgggaacctaagcgtggcaggtcgaaccgtgtggggggggccctgcccgtaacagaccccagcccctacccttacgggccccaacccttacaagaccctaaccttagtactcggtgggagcctaacccgaatagggcctgacattaataggccctaataacccttacacctgtgaccacgaactctgataggccataaccctgaccttgacaggtcctaaccccgggcccctaagccaaacgccgcccttgagaccctaaccccgaggccttaaccctgacccagagaacctaacactgataggccttcgcgctcttagtctctgatcataatcaccccgaccctaaagacccgatccagaagcctaaccccgaccctaaagacccgatccagaagcctaaccccgaccctgaccctaaccctgcccctaaaggcctaaccccgaccctgcacctgagcttgcccctaaaggcctaaccccgaccccgacactacccctaaaggcctaaccccgacaacgacactacccctacaggcctaaccccgacaacgacactacccctaaaggcctaaccctaaacccgacactacccctaaaggtctaaccccgaactcgacccgacccctaaacgcctaaccacgaccccgagactgcccctaaaggcctaaccctaaaccagacacaacccctaaaggcctaaccccgaacccgacccgacccctaaacgcctaactttggaccccaaccctaaccttaacggcatatccctgtccatgaccctgacacccgaccctggcactaacccttaccccgagcccctgcccctaagggcccaaccatcaccctaaaggcccgaccctgcccctaaagacctaagcatgaccttaaaggcctaaccctgaccatgaccctaagggcccgaccctaaccctaacctagtaccctccttccacaccccccccccgaaaaccgagcatagcccaacaatgaactcggccggtttaaagatttatttcgatgcgatgcgcggtcacgcccaccacaaaaatagaccctgcaatattgatgccggaaccagcccatcgcagagcgggcgaccgctacacgggacgcgtattcgtcgggaccgcctttctccggcaggtagcctacacgtacctcactatggccataaagatgcagccatagagaggtacgtgaagaagacccgtcggaatcagaagcaacatttcaggacgtacgactcgagccggacatgataccagacaccggagtccacagcgaccgcgatttcctctgcgcctaccctcggccgacgaacaacgccgagggtaggcgtcgagaaaatcgcgaccgagggtgcgccctcgttccacgcgatcccgcagaacgcttcgcgcccagtctccgtccatcgacgtggtgcttgatgacaggatccacctctaacaccacgcgatgcgctccgcagcgccttcgtcccggagtagagcgccatctccttcctccagcacggtgctcgacgcggcaatacaaaagtctcacgcctcgaacaccggacgaaggagggaactgcgcgcgtctggactttaccggggcggcttcgtcccgcggcgttccggatgacgtttcgagggcccactccatccttcggtgcggtgcccgagaagggatgacgacctctcacacacagcacaaaggacggcgctgggctccgtccgatgctctcgatctcaggcagcacggcaccgatccggagagcgcgtcgcacgtcgcgtcctacccccggagtagtgcatgacggttactccccggcaagcactcgtccgaaggaggacacgccacgcgacccgattcccagccgcttcgcgcccggctacttcttcgcctgcagtccgccggcagggctcgagcaaacaaactcccatctttccctgacggcatctaaccgttaaaatacgacgtcaggcaccgtaagggaaaaaatggaagcagttcggagtacagacgcctaaccacgggccctctctcgcccctccgcgtccgatatgcagatcggtgagagtactgatcgtctcatatccgcaacgaagacttcgggatcgatagacgttatccttcccgcccccccccccccacataggaacctctgttccatcgccatctgttacaaaaaagggcgagcctatccactggcaacgagcgagaacacagctaggcctcccaggtcgtaacaagccacttacgtcgtcgcgggggaaggtcggtccatttcgctcctattccgcaccttcgtttggaacagaagcattacacacaccgccatttccccgcgggcagaattctagtctttttgtggttatgctcccacctacccgcacagacacgtactcacctctcacgatccagcatatcgccgtaagatttacagacattcctccctccccacccaaccgaacactgcacagcggcagcctaaaagtcgctctgcggtcgcatatcccccccaccccccttcgatggtccggtgtacggagacctctcacacaacacaggacaccgtaccacggaccatccgaacggcgggcgaacagtcacgcaggacgtggacacgagtcctgcgctcgcacaggcagctgggcggcggtgctgtcttcctccgacggacagcctacaagcaagccactaggactaccgatacgaccagagtgacgtgcgtgtaagacggcccaggacgaagtcccgcgccccgccgaaaataacagcaccgacctgaaagagaccacgtcttacccaacagccgacccccgaacgatgcacgctcccaagagtcggccgtaggagagcacgcgcccccccatactcggcgcgcgtacccgcggccatccctgcagcgcggcccggcctcgttgcgattcagtgaacgtaccgcgcgccatctccgtccatcggcgtggtgctcgatcccgtcattcggtgatctcaagcaccccgcgaaggaggaagcggagcgtgtaacgatttccgcggcgcgcgacgacgccgcgccgtcccgtccgacgtttggaacgccgcctcggtccttgcgcgcagtacttgagacgatacgtgttaaaatctcaggcaccacgctaaggacggagcagagctcggttcgcttcgctcgcgcgccgacgcatctctgcttcgcagaacctgttttgaaaagaccgcagcgaccaccgcgtgctaccctcggaggggggcatgaggacggcgcccgatactcccgtgcacaccgccgaggggggacacggcgcgcgcgccgatgctcagccggttcttcgcccagagccctcccaaccttgtcccacacgacggggagcggcacggggaatcaattcgtctttctctccgcaggcattgcacaacggcaatgacacgtgcaatgccagcctgagagaaaacatacgaacagtcccgagttccgagtagtaactctcgctttcgcgcccttccccgactcgttccgagcatatcaggcgatacgaggcatttcgcgcgcgtcgccctgtccgtcccggttgtcctagaacgtgacacctctaggggacccgggaaggactggacgacgcgccgtcgtgcggtccgaccgcaatacggcgtcgttaccccttcctcacaacacctgatctcgtggcctaaatacccgctcatcgccccgcatccgacgcctctacctcccctttgtccccaaccgagaaacctatccggggcccgctaaggtcgaaccgccgagactccgtcgtccggctattacccgccataacaagtcgctagtcgaaggatggaatcgcagcggtccgagcggctctcctctgatatcccggcacggcctattgggattaaggtccgggcctattcagattacggttagagtcctcgagaaacatttcagtctctctggcatctgacaacggctacgcgccactcagatgccaaaacagactggatgcgtttccaaaggccatcgtgtctaacaaaggccagtccctgtaactaggccaaacatctcatcaccgtccaagtcacaggtacttcaggtttacggtcgtctgctatctacaacgaagaattcagagccgatctcgccagggccccttctcccccctcccttcttcccccctcccttctccccccctcccttctcccccctcccttcttcccccctcccttcttcccccctcccttcttcccccctcccttcttcccccctcccttcttcccccctcccttcttcccccctcccttcttcccccctcccttcttcccccctcccttcttcctcccttccccccccctcccctcttcctcccttccccctcccttccccccctcccttccccccctcccttccccccctcccttccccccctcccttccccccctcccttccccccttcccccttcccctcttctcccccccccctccccactccctcccttcttcccccttctcccacctccgttcagccttccccctcccccctcccttctcccccctccgttcagccttccccctcccccctcccttctcccccctccgttcagacttcctcctccccaatcgccccccttcgcaacttgcgaaatctagtctaacacgggtttacttacgcggtttacattcacacagcgggtgcatgttttccgctgacatttcccaagccggccacaagaaacgaagcaaaaaaaaaaaagataggggtattaatgcgcgccacccgtcgctacgcagcccgactccaaatttcgaataatgcccttctaggcattggaccgccgccccactccccgcgcaatatctaggcttaatcgccaagattgaccacgtatcccttatcgcgccggccgttcaggccctccccccccccccacgcctctcgactcttttttttttccatgggccgtccagactgagacgacacgtagattcgcggtcgtcccagaataaaggatgaccccgcgatgcccattcccactcgcccgacgtctccctccgattcaaaagtactgcggcacgacctgcgatggaagggaaaaacacaccaaacggccttaagttttccggtttgcctttcccttccatcgcaaatagcccgcaaaagaaggatcgcatttccggccccgtccggccatcgcgactcatccaccggccaaacggggatatcggaccgcgagactttaacggctatgtatttccccacccgctcttctcagaggaatccccgatgcaatctagaagcttatcgttcagagcgtttcgggcacggaacttcctgagaatatagatcatctctcagggtgcaccgtaccacacaacgtttctgtgggaaaacggaaggccagtcactttcacgtagacccctcaggatacccataacagaaaaactcagccccccctcccctcacgaccattttcctacgtggaatgcactacaagtacctgacattttgcaaacagggcgccgagacgtccgatggggttccagcttccgtggcggacgaaccaacaccagtgtgggcgttcgcatctccccccccctcccccccccccatacatgaaagacctacgattactgcataggaccccgctcctgggacaaatactccggaaacctccagggatcggaaatttatttagaaggggggtggggtacagggcatgcttgcttaggatctgctcgaaacttgactataaaaggcaatctgactagaatcgccaaaggcgataggtctcagaagaaaagtaggacgcgcgggggagggataattgtttacgcgggggggaagataaatggcccacggcggaaacgagaaagcgcgggggggggttaggccttggaagggggaaagacgcattcgcgcatgtcagaattaagatggcttccctataagacgaacgcacggtttaacagaaaagcggacatcacgccggggtcgaacgcgggaaaataaaaccgttgcgggggggggggggagtccgaaccgtgcggcgggaaggctccgagtccgaccggaaacggaaaaaggcggcacggcacggggcgctcaacgcacaggggataggaagaatttcccctcggcccgcggattcggatcgcgctcgcgatccaccttttctccgccgactcgccgaccgcccggaacgccggtacttacgcgctggagaagccccgtattactcttcttcccggattcggccccggcgcttctgcgtctgcgcggcggacatacgcagttgcgcttccgtcgacgtattcaatgtaaacaaggaagtcggccctgcgacttccgcgatcgcgatcgcgaaccggtaaacaacgcagggggagcgcggagcgcgggcgcgggcagggagttaacctcgcgatccgaccgcgcattcggatgtgcgggtcgggggcgtagagataacgcggcgtttccgctccgggccggagaggctggcgggcgggtctctccgtacattctttttttttgcaaacgcgccgctgcgcgcctaaacgccgcagcggcgcgaaacgcccgcgctctctaagcgtccgaaggccgtacggacaccggtgcgtccgggcgctcggccgggcgaacggcggagcttttctttctcttttcagtctcggagaaaacggcccggtgcacacctcctctcgggagcgtcgcaggaaagtaagttcgtgtcactcaccacccccccccccccgccatcgacacggagtctgagcatgagggctttaataaaccgatttgaacgtgctacgacgagagtccgtgcaagtgttcgcgctcgcgcctatacgtactacgacagccgctctgtagccgcggtgtgtgtgggggtgtgtgggggtgtgtgtgggggtgtgtgtgggtgtgcgcgcggccgggacgggattcctgattccgtagcacttcatctcgaatgtggaattcggttccgacgggggccgttaacacatatacgcgacactggtcggaactcgcgacttccacggtcgccgcgtaagtcagtggtgcttatacgtgggaacgaagcgaggctaagtagcaggtcgcgaacaaggaggtggaccgcggggctgtttatatcgcatctgcgtctcccgcggggccggtgagctaacggctcctccccgtcgcgaaactgtatcccccgcacaaacacctggacgatccgcgagcgacttatgatgcgcgtgcccctcccccaactaacccttcgcgcgcaccgcgggcctcggcgcggtacgttctccacaacactaatcgcacgcattcccggtcgcccgtcgccccccccctcgcacatcccgcctcgggggagaggagaggacaaagtacgttccccgacttacgcgacggactcccccgcccgcgccatcgccagacaccgaaacgggaccgaagcgagaaagactttttaataaacacgttcatacgcactacgacgagaccgctcgcacgcggtctcgtacacgcacgtacaccttaacgatcgacgcactgtacgcgagggctaagagcgggcgagcgatccaccccgtttcgcaagaaacgacgcgtcccgggcgcggctccgctaagcattcgtttacacggcagtttcggcgtctccctcctccggtcgtccgtaggagccctctgcgtttccccgcacggccctcgaaaccaaactccacagactcttccagacgtttgcgacgctaggctggcccggggcgcggacgcggtctgagggcttgagccggtggctgcagctcgtgagagcgtgttcgaactctgaaacgtaaaacggtccggctcgattccggataacgcaaacgtcttttcccctcccccccgatccggcaggcgagaccttcccactcaacctcggtcccgcacgggcttgggggggggggggggagggaaatagccggccgaaccctactcgggcccggacccaaacgacatcgctccaaaagagagcgttccgtttgacggagcccgcggtgcgtacctgcacgggattccggatcccgatcccatagcgaccaatctcgaatactgaactccgttgttccgtcggaggccgttaacacatataggggcaattggtctgggctcacgattttcattgtcgccgcaaaagtgagtgtgcttgtgtgtgcaacaaagcgagaccctctaccctgttcgtgaggagagggtcgcggggttgcatatatgtggcatatgcgttgatcacgggaccggtgagctgacaactcctccccgtcagggaactctattccccgcattaccacatggacgggccgcggcgtcgcggcgtttcccacacccctccaccgaccatgccccacccccgctctcgttcgagaggccgtcccctcccccatttcgttccgcctcgtccagagccagcgcgggacttcactttttccccatccctctactcctatctcgttgcccagcccacgatcgctatgtacgcgttctctccgaggccggctcgcgccgagccggccagacaaagtcacttcggaactgacgccgaagtgagtgctgaacggttgagggggcggcgtatcgcggataagctattctcctcggagtctttttgcggcaggccgcaagcttcctcgtacccccctttcggggttcgctagaactcgatcgaaacccgagacgagttactactgagccgatccctacagctcgggaccgctcccgaacagaacgcggcctcatcgggttctttcgtagagcgccgcaagggcagaaacggaccgacgcgcgtccgagactcatcccgagctcacgccgaacggctttattgctccgcttccgaacgagagagcggtcctatctcgaccggcccgttttcaatcgattcccgaggttccgacctcgccgcgggtgcggggccggggggaaagtcggggggcgacccgcgaccgtgttccgcgagcggcgttcggccgcgtcgccgacgcggggtcggatctcgttctcgtgcgagggatcgggacgatccgcggacgagaacgatggggcgtcctccctcgacgtccgacggttccggacgccgcgagggtcgcggcccgaaggcggagatgccgagctcggccagttcgatgccctcggtacccatcccccttccacccgtcggcgacccccgcgaacgcgagccgtagacgacgttctcgggacggcgcgcgatcgcttcccggccgcctgcgatcccaacgggacgggttcgttcgccgcgcggttcgcccggcggtaaaagaacgaccagaaaatccgatccgcgacggcgggcgctttattaccgcggtcccgcgctttcggacggcgggccggccagcggaacgacggtccccgccggacctccgctcgcgtatttgtaggccggaggtccccgaatccgcccccgtgggaggggggcggcgtttctagcccccggcgcgggccgcggccggacacgaacacgtggcataggatcccgcttcccgattggcccggacgggcgttcgcaccttgcgccaataatatattatatatataatcttatattggttcgcggtgcgaacgctgacgcgttcgccccgctcgtttgcattgcatcacgtgatcgttacgccctcacgaccggcccggtcataagaagcggaggcgccggatctccgcttagagcgccggtccggcgcttcccgcgaacggacgcaaggtggcggcagaggataagcgatcgccgaacgagagccccgtcgggagcgatcccggatcggacgccgcggcgaacgcgtaggtttcggccgtctcccccttcccttcccccacacatcctcccgccccccacaacctcctccccggcggcctcggacggcgcctcccccgctcttcccgaactgcaggccggccggctaccctccctcccccctctcctccttccccccctcccccttcttctcccgtccgaccggcccggcggaacgcgatgcggcgggggaaaaggcgccgatccgacggacgcgatcgcgacccgaccgctgatccgcgcgcccctccggacgccgagagggatgcggagcgcgagagcggagccggggacggagggggcgacccggacgccggagagaacgacgccggagggcgcggaccgggcgcggacccgggcgacgacccgggcgacgacccgggcgacgacccgggcgacgacccgggcgcggacgcgggcgcggacgcggacgaggcgcacgcgcgcctgctccggcgcgccgagcgcgaaaacaagaaactccgaaggggatgtaatttagtgtttactataagcaacaaaaccctagtagtcggaacatgttttatgcttgcggcaggtgtactagtcggtgcaagtggtgctgaccacgagactgcatgcaacaaaactaatttgctgttggtatttgttactgccctcttgacacgatttatttgaaacggtaacgaatgctcgtgtactttataattgcatgcccgattacaatctgttctgtaagaatagttatacgtagcgtgttttacatagtcttcgatgtatagaagagacgcagtcaacttgccggtgccgtgaaattgtctccacactatgatgtttttactgttacaaggtaattaaagaccttcgagtttttcactccacttgtgtgacgctccttcgattatgagagtacaatgtcgtctaagggggatgtggatcaccacgcgggttatggggtggcactcgcaattattgctctattgctcgtacatgctactgcactgattatggtgagtgtctttttacctctgtcccatcagtaattgctaaacaatgattgttttaatgccaaaaatctttttttagatcttttctgatgtcaaattcagaccagtttcacaggatcttagtacgcagtacccatctcataagcattatgatgatgcgtactcgccacatatgtctggggtagaccacggccattcggatgtatggactaacactgtaaatgacccatccggcggaataaactcaaatttgcctggtgcgaagagcgtggagaagatctatcctagcgtagaaccaagtacgtcgcatgacaaagtgtcgtatggaaatgcatggggaggggacataaacaccggcagtgtttcaccttctgatgacaaagcattgcccgccactgtcgaaccatcgacggacatcgtttccatcgcgatcacggggagcagtttaaacggagaaagtagttggcggatttctaaggatggcccgcgtcgggtttatacaccacaccagactaaaagaagtcctcctcagatcgatggcacgcgtttatctactagaacggcatacttgagtgtgtgggatgaacaggaggggatttttaaaacgttcccggccaatgctgctgcattcaatttattggacgctaatcagttagagaaagcgcgccgtgaagtttttttcgttgtgtcggtgtggcatggaaatacgaacgaaacccgtatatttttatccgccacgaggctactgacgcgaatgatgtccacatcgctcgtcgtttatctttcctgggactctcgaggggccctggggacgacaactgatgcggcttttctggcacggagcgtaaatatatcccagttcctgaccgctgtaccaccacattcgcaagttcgttgtatgggccattcattaggaatgtatacttgcggttccatctgtagacaatataatagtgtaggtacgaccagatgcaaaagcattttaagtattgatccttacggcgcctcatcacccgagtctcatgtatcctcggcagacagctcaaatacaatacgctttgatgccgactatgttgcgattttcgcaacaagtaagtggcacttgaacacgtccgattcaaacgcagacgaatatataatagtagatggcttgaatgcaaatgctgtgtgtgtcgatccctacgagtggagtgtcttattgtgtgttagcaatcgccaacgaaatgccgtttgtgagcgattcggtgctaacaacgtaacgactaccggcgaccctgcggaagacggttcggaaacatgcatgcgaatactccctatactatcggtgctgcagtcgctcgataagaattctgcgtatccgctgttacgtatggatccgccgggagcttctgcagcggtaccatccttaccgtccacatggaatatctacgtgatgggaaaggattacagatattctacttatggaaaaaatgagagcctgtggtattctagcgccgtgcatatgggaggaccgggattctttcctgcgtcggtatttactgtgtttcttccctcgggtatacccgctgtggtatccaatgtcgtgcaacacagtagcatcagttacggagatgtagcggttcattccgctttcttaactgataggtccctctactacccccgagtgatggtccaaacatccgggcctattttatctgcctattcttggagagcgcgactgcataatgacagcctctatttattaccacttccagaacaggagataatgcaatacaaatgcgcagttgcacagggaagctatgcatgtagtcccacaggcccgatcttgacaactgttatgtggcgttcactgttattcgcgggcagatcttcgccggtgcccccaaacggtagttgtttgacttatatccccgctaacacaatcatccggagccggtcccccattgaaataggccctcgaagtattataactgcatcgtttcagctaagcagacaattaatggctatgacgctcgaaaatcatttcacgtccacgaaccggactctattgacatttcatgatgtgtgccacgacactgctatggagtcggatatatacttcgagtataactggttaggcgcatcgatgaacattaccatactgaaccccggcctctatacgtttagatggtttttcccatttgaggttttcgtaatgccggtggtagttacgcctcccaagtccagagcggataccgtcacgatcgctcccgtaggactataaccctgttggacaaataaagtatacagactgttcaaactgtgtagtgagtccatcttagtcgtactggatgcaaacgagcccaataaagtgtaacagttgggaaaactttaactgtcgtgggataacccttataatgttatagtgcagtgactgacttgtaagcaaacattgactggaagttagcttatactgtacttcgtcgagactgccgttgccgactgtacgatggagcggcctctcgatcgtgactatcaaagtgcgataacgtgcttgacgtgcgagagagtacttttttgtcgcctctgacatgggcaggttcgtggcgataactccaactacatcaatgccaagaggtttaagcgttaggtcgccggtttaaatactcattcggaagccgtgggtggcgcctcgcgtaccccagaccgttgtgttataaaacccagactcgtcgccacacatgtaggcaaaaaaatgactagcgaaagagctcttgcgctagcacccggtcgggcggccacggcagatttctacgaagtggatccggtatatcggcgagacttcgcacgccggcttttacaacgtaagttccagcttgtcgtgttgtagaggtatttactactctgatcttcacctaattagcaccatgccgtttgtatttaggtttattccccaagacgcttgccgccgtcagggaatcggagggaggccgaaacacgcgcccgcccaaaacagatctgtgtacgcttttgcgcataatcgcgcatcatgagaccccgcacattttcaccccaggtcccagactcccgaaatcctcagcaattgtcgacgggctatgggtagcgtgtcgaggacttgcggcagagtgcatgttcgatggccgggcgacaatagagttagcagaacgcctcgcaacttcatggttgacggccataagattaattctagtttggcatcccgtgtatgccctcggccagcaacacgaaccactcgagcggatatgtcgccaaggtcgagaatatattgctatgctctcgggaacgattcaaacatcgtatgcgacatggccgttttggcaaatgatgcaacgatgcttagattggtgctgctcatttcacatccccgatgaccgttcttgtgagcacggatctccacgtctggggatccaactagagggcgaaaaccagatattcgcgccaagtttggggctctactccgctgtaatggcatggaccccaattccatgtcacgtacaggttcctgtatttccgagacctggcgaatcggacgatgtctcgaccccgcctagtggggcacagataggacgggtgcgacctcacagtcttcaaaggctggcactaaaacacagacctattgatgccgatgtacatagacccatgccgttaggccggccactcccttcaatgcatatggacgatccagacgatccgcaacctggaccctccggacaaggccgggcgcccagaactccaactctggaaggagtccgggtcgcagaacaaccggtaagtcttcgccgcgcaagaacaccaccgccgccgctcaatgtcgacgaagacgacaacgatcttcctcccggccaacccccccgccctcatcttcgaactcccccatcatcaccatcgtcctccgagactgaaatcgatgaggaacttaacgcgcaacccgatccttggggtacaaaccgtagctctacccctacagataactcctctgccagtgaggatgaagccagagggagcgggttgccccgaccattgcgcagcgcgactactgaaccgcgcgtaacgcgtagaagccgccgtgaggctcgcagccggagccgaagtcggtctggagaccggaggtggggaccgtcccgattaaggtcaatgcctggacgcaggagagcttctcgacaagatacagtacttgtagacagttctgaagaggaaccgtagccgtttgtagtcagggttctagttaagtaggcgccgcgcgatttacgaattagtacatttgggccctgccgcgcagcgagcgtctcacgactgcgatagtcatgcacgtttcgctggtatgggtgctgtgtttgcttttcggaactagtgggggtgttttaaagtggtctgacgttgacttgtcgcggggattcatttcggtcccaaatgtaagttcgcttatgcttttagactgcgctccaaattcgatactctcaactgccagattcgccgatctgacaacagatgatgtccctaccggtatatttattaagatcaattgcagcgttccggaattcattttatggtatgggtctaaaagcgtggcggcgcggctcaacccaattattgcaagcgctttaatgatggacgatgttttaaagagcggattggacgattccgtgaaggcggaacttcgcgtgtttttaaaaagaatatccgaacggctaccttggagctctctccggaaaagacacggttgtctgaacctggacgcaccttatgacttctcctgttatggctcggcacggctcgacagatttgaacgagacatcgaggacgatggccgcggaatgtcatgccgagctaaatcaacccgagctaaagcggcccgcaccaacgccatcgagggatagttcggccgcgattaaaaagcgtcgccggccgatcggacctccgcccggtttcgcgccactgggcgataatgcgccatccccacagggtgaaactgacgcgtacggacatcaactgtcgatgaccgaaaacgtccgcgctgaattgtggcctgttatagccgagtcttacaacatagactggagttggaaagattggctgctccccgaattatgctgtcctaacggctccaagttgttggcggaatacgaacgccgtgctgcggtagaagacgtctttcctccgcgagcagatattttcgcgtggactaagtactgcgctccgcccgacgtcaaagttgtgatcgtcgggcaagacccgtacgttcatccgggacaagctcacggcttggcatttagcgtcaagcgcggcattacaattcctcctagtctgcagaatatattttcggcagtcaaggcgtgctatccctcgatcgaactcggagcccacggatgtctagaagactgggctaaacgcggagtcctgttactaaattccgttttgacagtaaagaagggggagcccggatctcatcactctctaggatggcaaactctggtgcgaaacgtgcttcgaagactgtcgttgtcgactcgaggcatagtcttcatgttatggggagcgcgggcacagactatatattttcaaacggatcgcgacgatcgacatttggtgctgaaatacagtcacccgtctcctttatcccggagaccgtttgcgtcctgcacgcactttaaagacgccaacgagttcctctgtaaaagcggtaaagggggcatagactggagcattggcgcgtaagtgacggaagggttaatcatcacatgcgtacaaaagtcgcagcgctctaggacttgtcgctttctgcgcgcgcaatgaacgataccgcaccttctgttttggcagtattatccaactggggttggaagagcacacccttgggcaccgtaggccccgtcccgattcgcgacgagactgagtgcgcgcgcgaagaccttccggcacatgattgcgaccactggtgtaaaaccgccaatgcagaaaacggacctatggcaccctccccggggaatcgagattttgcgggaaaccaagaatacacacatttcgacactctgtttatggtctcgtctctcgacgaattgggaagacgtcaactgacagatactatacggagagatctaaggcattctctggccaagtttacaatagcttgtactaaaacctcctcgttttcttcctcgcacgccacgaaaaaggttcgcgcgaaaatgtttcaaagagggcgtcagagcaacaagagcttgcagatgtttattttatgccgcagggcacacgctaaacatatccgggcccaactgcaagcggtaattcaagctcgaaaaccccgcaagtattacacccgcgccgtggacggaactacgcatccggtggtgcccgtctttgtatacgagtttgccgccatagacgttgtcagtttgcatcgagacaacgtgatagaggtagacactcccggctcgtgagcttctcgccgctcatcatgttcgtcgtttcggcagctttagcatccgcatcagactacgccgcgtttttgcgggacaacaagcaagctgctcgcaagctgcagtttccgttgtccccgatgccgagccaacggatcccgcatctgtctaaggatggcaggactgcagtcgcccgggaaacggggtcgagcgaggttatgtcagcgagcggacagaacgcgtcgacccgaccggtcgacgctcgtttcgccaacctagacaccgagaaatgacaagaagcatctaaaacgcgcttgattgtcgagtggctgaataaaatctttattgatcgactcgctttcctatttctgatttaataaccatagatggggcggggaatctataaaataggcaaggtccgcgcggattcgagcacatcgaccgcgtccgcgacacagcatgcaagtggcgacgaacggtcctcaggcatgcacgactggtctatctgtatatctgcctcgcggatcgcttccgtgagaaggtcttcctcgtacccggttgagaaagcgtccactttcgagggtccgtacccgtgcacagcgccaatttcgtgcgcttcgatgcacttactaatctcgggcgcgttttcgggcagagatcttatcggatcgcagctctgtcgatgcgcatctttattagggtctgcgatcgcttggcaatacaatcgcgcgctggattcgtgaccgacccgcattgcattggctgtttgtgtcaaagagccgggcttaccgtagatggtgatcgttatgtacagtgacgttcccatccacataacggttaaaattcctccggaactgctgtataagtaggcatccggccccgtcacggtacacgtagcaaatggtatgacgcacagggattcgggcagaaaggagagcggcgcggcatggtattcggcgccgcactcgccgacgcgtagaagataagagcaaatgtccgcgccgctgtcgacaatgatcagggtacctaccggtcctcgctgtatgataaagttcgacgatgggatatgatcgcatctggtcatcttaccaacggcaatcgagcgcgtaccgcctgcacatgagcaaaccatctgctcataaggaggcattgtccacgcgggctgagcagtgacgttctcaagcgtatacgcgatgaacgtggaccccatcatatccacgtctcatgtgacggccctatgcttcatggccctagttagtatacaatgtggactttcggatcccggagggcggctaataagtgcgcgctgatattgttatcatccctagtatgcgtttcccgaagtgggttaatgttcatcctcagaaacttagaggaggtcactcgagacatggccacgtagacgctgctgagtttgatgcccgattgggcaaaacatatagcaaccctctcaaggctaagcccttgcgatctggcgatagtcatcgccagtttggagcttattccgtagtcggcggttacggccatccggagttcctgatcgtctaccgtttcgacaaaatcattgacgttggtgttaattgctgccatgaaaccgtgttgatctttcaaaaccagggtcggcatgtgaagttccccgagcgcttccgcgacctggggatgtatcttacgtctaataggctcgtctgcaaatgtgttaattctagcgtatgtgtaacccatgagagtgtagctgtccgtctgcaaagcgagcgatagcattcctccgcgcatgctatttataaatatttcgcaccctttaaagctcacgttgtcgacataactatcgaatctggacgctgcaaacttttgcccgaatagctccgtcaggatagaatacctgcccataaacatgctcttaagcatgctgaactgggtatatatctccgcagaagtttctgcgcgtccaaattcgtaattgcaataaagcatgtctatcatctggtcgtcgaaatccataaatagggcatcgtctgtatcctccacatgactgatttggtcattagctatacaatctaattccttctcactgccatagcggtgtcctggaatcgcgaacgactccctctgctccgctctatccggaggttgccgtcccggatagagcagcgcagaggtaagcatcgccaatctatcgtacgcgcttttaacagaattgtctggaagaccctgccgttgcagatagttgtagaactgtatcatgccgttgaaaagcagttgagataagaaacggtacacgtattctacagacccatctccgtgcgtctttatgaaggaatcgtctttcaatacggatagaaatgtctcgaacgtcccgcaaaagccgaaaacccacttccgaagtcgggtagtaacagccacttggctgtttaagacataggcaatatctacacacgataccgcgagcccctgttggctgcgaatttcacatttggcctgtgtggcatcttggtcgcgactttgcgaccagttgctcaagcgtcccgcattggcagcaagccatttttccaacgtaacgtgcggttggttggcagcagtacgatatcgttcgaaactatccaaactgacgaaggtataagccggcagggtaaacactacaaatttcgtatttccggacgttttcaggtagtcgtgtaatctgctcatgtacgcgctgacttctttatgggacgaatacagacgcgtccatcccggaaggttcgcgggattgttgatgtatgcttctgggacgacgaaactatctacgatccgagcgtgctcctcggttatgggaagaccatactctaaggtcttgaggaggtccccgaactcgggttcggtgcaccgtttgttattaatgaatatcgcccagttcttggacagttctaagtacgagcgcaacgtctggttgcatataatatacgtaagaatattttcgctcgtacgcacattacacttcagcttgctatgctcaaatgtggactccaaagaattcgtttgcgtgggcgacccgacgcatatcaataccggcctccttcttctacagtactgcggcgtgcggtaaacggcgtttgtgagccaccaactgtatacgatagccgtaagcaaatactttcccagaagtccagcctcgtctatgacgattatgttactgcgagtgaacgagggcatcgaaccatgtatgccgaagattgtccacgccatactaccgcgaggcttgcttagcagatcctctaacgcgcgaatcatttcaaaccgccctggcccgacctcgttagacaccgccttcaaggcgcattttgtaatgtcggataaaacgtcccaataatacactatatcctttttctgcaattctttcatcgtcggtgggctggtcggacatacgtactgatattttcccaaattcgcttgaatgtgattacctttaaacccgaattcctgaaatatcgtgtttatgtgctgcgatgtgtatgaattgctaagcttgcaataaatattctgcgctgcgacctttgtcgtgccggtgataatacagtccaagatttcggatagcatctgtatgcacgtgctttttcctgagcccgcatttccgcttattaagtaaacggcgaaaggtagctcgcggagttctagatccaacgggctttctagttttgacgcgttcataaaatacgatagcggggggactatatcatcgctcaccgatgcgtccgccaggctccttacacgcgcaatgatagtctgtatcccgtgcatcgcagtgaaatttagatacgttgcctcactgaagaaatcgttctcccgcgacatcgtcggtcttggggaagacgggagtgacgaatctacgtatcttttagggtcggggctggcgtgttgtttatttccgatggagagctcagacgttcgggccgcacgcagtcccgccctaaaacaaattcgacggccgcagttgcaatctgtcacgcgccaatggaaactttcaagcgacggcgattcgcaacagtccctggaacaggactggataataattcaccctactcgccaaacacgtatgttcaaagaggtcctcaccgggcaattgggatatacagatggacagggcatatataactcggtacgatctacagaagccgcgattcggcagattcaaagtaccattctcaccctttctttagatgcggtcagatatgacgacttgaaagaggattggtcgaagcatatggataggcgtgggatgtcggccaaggaaatcgcaaaaaagtatggcgttcatagtgaagccgaagctgttagaatggcaaagggggtgttttcaacttggcgtaaaactcttcaaatgaccttaatagaattggttcggcacgcaacagattgcttcgccgcggccgagaaaaccacgtcctgcttctctaaatacatagactggatctgctgtttaggtatcgttccggtcgtcagaagcgagcgctctatgcaggcgtcgcggccggatagcaactgcagagatcgcgctaccattcgcccgaattgggtattcagcgatgccaccgctaagctactagttgcggatagcgttatggcccgcgcacaacaaatcgcggattacttaactgcatccatgcaagcactgactgtgatagaatacgatagggcccagatagaatataatttcttaaaacgtgaacttcgcgttaaggacgtgttgagcggcgaacgtggcgagtgtatcgttatttggagaccggtaatgaacgacggaggggtaatttttgattcgcccatgcagagaatctacaaggagatgattgaatgtcacgatttgcggatgcatgcggcgctgtgtcggctagtaaacacggcccctataaaggtcctcatcgggaaacgcgatgaggatagtaaaagcatggccggggctcaaagagcaatcgataaagttctgggagaccaaactgaaacggcggcgagctctgccgcctctaggttggtcaagcttataattggcctcaaaggtatgcgtcatgtcggcgatatcacagatagagtgcgggattacttggaggaaaccggcggacatttattggatgcctcgcccgtggatacatctcagcctggcttcgggcgcgctaatcgaccacagagttctacgatatccgatggaacttgctccaataccgctagactacgtgatgcgttccacgcgtccgtcgtgacgagtataaacgaaatgttagagggctatataaataaacttttccataccgtggaagggttaaaggcggccaataaagacttatctgcaaaattaagctctaaagaaatagagctcgacagaatacgcacggaagccctgatctcagaacgggcgcgagctgacgcctcgtgcgatcctcactgcaatccaaccatggaaactttggtgcgcgagctaaaacatgacgtaattgacgtaaccaatgcaatggaggatgagtcctatatcgcgaatagcttccagtctcaatacataccatcatacgatggcgatttgaaacggctctctaacatttgggaacaggaaatgttgaggtgctttaagatgactcgtatcaccagtaatcaaggtcgagaggtttcgatctcctactcaaatagcgctataactttattactcgccccctatttcttctccgtgttgcagatctatgatattggtgcgatggtcacgagccaagacgtttacaagtcggaggaggagttatgtaattccgtgcttgaaaaaacccgactttgtacatatctggatgatttggctctcgtctttgaggccgatgtgaaaagagctgtcgcgaagtattcgctccgtgcgggtaacgccgaaatagacttagcgcccgaggagttttcgtacggctctcatggaagcaaatgcgagacacggttttcatccgctagacacgagcgacacgttggacgctctagttttaagcacgctaaatggagaagtcggccaaaacgagaccgtagaagaactaatttggcaaccgacggcgcggatgatgatggagatccgagagattcaaggcggtcctactcaattcacgggcgtctccgtgagtaaacttcgcgtggcaagatgtgatacgcgctttcatctgactttaaccggagccgacttggatgatgaaatggcaagtgacgtataccacagtcagtgcatagttaattcggcgttcaaaggtttcgtctttatggttctcacggttacggaagatatagtgcggacgataggggttccaccccctctgctaaaatacaggctcgtgttctataacccatctgaacatttggacttcgcattatgtttgctcgtagcctatttggagaatctccatgcaagcgcctgcgacgtaacttttttcgtacaggttcaatcttttctgagatacgcatggacacgggtgacgccaatgaccaaaatgcgcagatttttatgcgccacgaacgtttggttactaaacactttgatgtcgatggggtcctgtagcccattcgacggagatcgagtactcccccattatgcgatatacagacatttgtgttctaccagtggcgtctgcgacgtgttactaaccttgtttgaacccgatacacggcaggtacgtgaccgcacgcacggcaagggacttgtcatgctcaacagaggaattatgaataaggcttttcggcagacatggattagtgatacggtctacgattggtggaccggcgaacgcgagaagttgatcggagaagaatctctgttcaacacgtataatatatgaataaagtatgacaggcactgctataaatagaccgtggtttcttagcgttttcatttatttattgcggacgaacagaaacctgtacggctctacgtcgaatgtgaatttgctgagatcgacgttaggccatttcgatgttagagcaccgatcagtaatctcgaaaaaatggacattattggtttcatatgatcgatgcacgcgatggcagggagaattacttgtcccccttcgaaaagtgaacacgtgagaggtgctatgctgccgtccacagtcacggtgtggacggcgtcgttactgaaggcgctcgtatcgaatctagctgccgcccgtagtcccaaagccgtgatatagtgagtgtggtcgcgcgattctgcgggacagctccaaaagcaggcgtctccgcgggcttcgaaagccgcggtcacgagctcttcgaacactgcacgcgatcgttcttggattgtccgtagggactcgtcggaatcgttgcatgcggaaatttcttctaaaagggcagacaaggctttcttaacttggcccgcaaacgcaggtcgggccggaaaccccacgaaatctgtttcccgcttagtttcgttccacagccagtaacaattggcattccacgatactgcatgagtgtataccccttccattcgaaactctaatctgatatcttcgggaaaccgtagcccgactgacgtggctaatttgttagcgctcttaccgcaagcgactcgtagtgtttctaaagcggtttctgttcctttagaggaatgcagaacgttgttggccccgtccgtgaatgtcccccacagtccatctttgacgtaggtacacggggcgaatccgagagccgacgcggtagcttctacctcgagactaatatgattcccgatacagataatagctctataaacatcttcacgcactcttttcaataggcctccgaactctatgatgggctgcttcaaccagtttttctcgcgctgcagtcgagcttttaccgcggcgcgcaaccgggaatgatcgggaaacagtcctagatatagagtcgcaaaaaaggcgctaaaatcaaactttgcgatatacgcttgctctatgaaagtcggttcccggaaaatacaagttatccgcccagccgtccagtcgtcggctacctgacgccgcgtactgcttgtgcgcccttttaaattttcgagtacgtctataccaggggtcggatgggtttccggatgccaaggagcaagcaggtggaaggttctcggtccggccagtggccacaggccatcggtctccgaatagctgccgacggcctttctgatggccgagggggccgccgtagatgttttcaagagcggccaaaggggaaatccgatagtgcaggcatagtcaacgtcctcgccgcgcggactggtttcggggccaatatatacaaatataggggccagccttttttccgagtcatcggctagagagtatatttttttgtgccactgcgcatagatggccaataatgccgtgagagaaaattcggcgggtgtcgtaaccaagcagtcaaaagacgtcggaaccggagccgcggtttttatgggtgcctgtgagtcgggtaatgatagaacgcgttcgacgatagtgaatattctattcgtatttccccatttgattttcttggacctgcgacccactgttttatattcgcggatgaaccggtcttcctttgtgtaaatttcgatacgggagtcgaattccgggatcgtgtcgtcgtgtttaagagccgacaatttaatgtgggctaggtgcgcgccctcagtatactccatagccgtggatacgaggcgtgattcttctacgtgcacggcaccgtccgtttttagtagccccggacggggagcacatcgatcgcccggcagaggttcgcacgatataactaatcccgttgttgtgtctacgtacatatcgacgggtgcgaagtatgcatgataaccgagcttaattctcaattttgccagcgtcacggcgagcagcgctttccatagagcgtgctggtccggcctgcaagacggccaaactcccgtcacagatccggcactggccataatcgccagtgccgcgtcggttactgaatccggattcaatccccaagctctcgcgatagaccgtcccgatacgtttaccgtagagtaatgtgcagaatacgtaccgcactcatttctaaaaagcaagtaacacagtgcggtaagaccatcggtgcggtctctactagtccatactctatacaaagtggtatagcaaatacacccccggattttctgtaccgccacagtattagcctcagccattgttgacataactaggttcgctgcgtacgccttacaaactgtgaaaatctatagcgccctctacacgaggccagcacgccgggggaacttctgccaaaaccgtctccaggtccaaaatgtcgtggtatatgcccaattccgcgtccaagcgagatttcactagcgcgtaccacttagggcgtcgaatctcgtagcgcgttttgcggaacgacgctttgtttttcataaggagtgtgtaaagcgcgcggtgcgttttgatcgacgttctatctatccccgccccatccaacaaagcttctatctccgcctttcggagattcttaactttggtgccacccggaaacgtcgtcgcgctctttacaaggcgtaacccatacagtatttcccatgtgactttaaaaacagaaaaggcgtggttctcctccgtctgccggcccaagggatacctcgcgagaccacttaacgcgcttttcgttgttttgactgatcgtttagaggcagtacgggcatccagcagataacatcgcgtgacttccaataccgaacgaataaaagtatcgtactcattttgcatcacacgcagcatcgataatggatctaaatttttagctgttccctctaaagggttaatacccaacgaggtcgcccatctgcagcataaccgatataagtgccaccttccagacacgttgaaatcggccgttattgcgacggtacccagccctccatcgggcccgattattggtaagctgcctgatgcgtaatactgataaatacgacagaacacctcttcactataaagagcggccggcgttgcgcgacacgcttccaacatcgtaatatttataaattgttctctagtaagcggttctgccagtttagttaataattgcgcaagatcgctcggcgatccgtcatgtcttagatatttatgaataaacggctccaccatctcattgtcgatcagatcagcctggatttgaccgcaggcaattttacggaggtgtttcaaatctcgttgagcgataagggcgtctgccgttaaatccgctaagaaggcgcagaaggtttcagcgtccaattgagagtcagatccgtcaaatctgacgcttattagattcgcgtcaagtaaggcgtggagaatattgatgctgtcgctaagattgttgagggtgcaccgttcaaacaaatgcttgtacttaaatcgtgggaaaatgtataacgcgtcggcggacttgaaagtcggaacgcaatctcttctgaaattgttacacaacatattggtcgcgcatacgaattgcgccggccatcctcccccactggcgatgacgtggtttagtagcatgggtgtgaaaactggctccgaacgagctcccgatgcatctatgtaaaccaagacttcgttacggcgtaacgatcggattctacctaaagattgatagaccgaaaccatatcgggcccgtttcgcgtcggcttaatatacgcgaacatgctgtggaagtgggagctgataaaacttaggcctactgttactacggtagtgtagatgacaactcggtaacgagtccatgaatttatatcaattggtatatcacgggtggaatttaagaccaggacagaatcggtaaatatgaggcagaagcgtgccgccgcttccgagaatgaaattgtcgaggaaaataagcaaatgttcaacccgcccgcgagtcttctgctgagttcagaaaaaaacgtcgtctcagtcacgcttctatgccgagagtgggtaccgtcagccccgtgtttaggtgtgggtcgtacatgaaaacaatctgattggtcgctattcatgacggagagaagtgtatctgttcccagattgcggaggatggtacatgatctcttagaaaacccaggggctgcgtattcgcccacgatgacatgtatgttatcttctcctctcatgcttgccaacatatctaccagttgtgtatttattgtagcgtccattgctatgatcctcgggcaattacgtaacagagtcgttagtatcgaatcgactctggacagatgcctcatggttggagagtaaagttgactaatggtcgacatgacttcgtccagtatgatgatttcataccgtccgagcaagtcagggtctatgcgatgcaaagattcgatttggatcaacagtctgtaaaactctctgcctcgtatgctgtagtcactagccgtcaaatagttgccgaaccccgacagcccggcattgctcagtttgtcgaataatgtgttcgtaaaacttcgcctacaggacacaaccaaaacgctcgtgtccggattatataaaatacgctgcaaccagtctatgagagcagttgtcttgccggatcccataggcgcgcgcactacaagtacattgcgcgctctcgaggacagtggcggcggaaaagtaacgggcccgtcggattggcgctcggtcgttactccgggtctgttcttagctatccaatctatgagaccttctccgtataatatcctcgacaaagaggcgctacagacatagtctatcattttctgtgcggtcgatgctctaacgtcgccgagaccggtgctccgggtgaggattacgttctgacgaccagagaaccgtctacgatcgtcgctatgtcaaaaggaccgcgatcggaaggagcccggagaggagcagatcatatagactacattcacaaaaagatgtgggttgtccaggcggcgtgtttttctgtcgccgtcttggttttcctaggaaccctgatagctgcatctataaacatgaccgaaggtttcccatgcttttttgcggccgtcgtggactacgggatgacgaacgtgacgcttgtgcatacgggcatgaccaatccgaggctgggaggcgtagttcctgtgctgtttttccaaaccaaagccgtggcgtttctcttctattcggcgagcgtcgtttttgtatgcatcacgtgttatatcgccgtaggcgccatcataactagcaagaaacgagtgggtgctgcgtataccggaaggggcgcgttcgtcctttcacttatggcatcgccctcgacaattttgttgggtactgtgtcgatttggcttcttcaagcggtagttatagtcctagcccacaaacttattgtactagccgcggcggtttatttagtgcacttctcgactataacgtttttttatgggtatttctgtggaaggggcgttgacagtaaagtatatgcggaagacatcgctgctgcgaaaaacgtagacgccggtctgcacagattaattggaaacgggcgggcggtcatgatcaacttggtttcgatcgtatacagtatgcttctgataatggcgtctctaatgttaggcatgttactagcaaacagctttaccttaaagttttggcatgtcatcgttaccgtcctcataacttcctcagtcttaaccctaatgtatcttttagtactcgagttcctagtggcgcggtacgtgcacatgattttgggtgcgtacataggccttctgatcgcctatgggatgctctggaccacctcatgtgattatgtcaaccggttctacttcgcgatgggcgtaggagccggcaacttacgcactgcctgtcacagcgtgctggcgtttttcaccgtactgattgtagcgggcatgattgttcgcctaatccgggccgggttgtatcaccgtaggcgatctactcgtgcatacgccaaagccaggcagttacaaagaaatgtaaaggagagattgagacgaatgagtcggggacgcgatcgtcccgatagccgagctgaggacgagcgggcgcttacgcaaacccaatatagcgaaacatcagacgacgagactatatatgatcgcgtttattcggggtctgatagtgaatgggatgaataggaacgcccgaaacataataaaacgctaaatctacaagtgattgtcgcgcgacttatttatcactataacgtatcgttacattgttcccgaccgtccttaaatctgaaaagcgtctttcctctcgcgcaagtacttccagctaagacagtatcggaatggataagagggtcggaggacctaagaccgtccaaatcgacggtatcgtattgctcgtcgtcgagctcaattacatgtcccgttttggtcagaacggtgtttcgtttccgacagcgtcggaacagttccgttacggatattgcttggcccatacttgctgcacgagttcaccgaacgcacggtatccggcctcttctacttcaccgtagaatgtaacgtccacgaccacgggagtgatgaggaggagaacgggaatcgcttgttcggggtctattttgacgcttggagtgggttctccagtgtttccttcggagatcgtcaggcgtctacctaattcgccaggtcgtctgcggcggcctataaacgtggcgaggtgtgggatgaccgggttgctttcaaagtaattagaagctacgtagttctgaacgaaaatctgcttgaaatttggatgtcgtgggttggcaaatatgggcacaaggacagattgttctccggtactccagcatagcgggtgtatcgcgttcgtttgcagatcaggttcgccaaacagccatacgcgagaactgcagttcttattggaggccaagtgacgcgaatcaaagtcgttccgtttaatgtttgatgaaatggcgcggaagcgtgatagccccactttccagtcgtcgtcacatgtgattagcgcctcctttgccttaggaaaatcgtcaggtttaaaatagtccacgcaaggatgattgatggcgtataagaatcttcggagcgctgcgacggttcttgtttgtaataggcgttcgtaacattgagatagctcgcttcgacattccgggtaaaacgcgtatttggccctacactttatttcgtacgtttctatggagtggtcggggagggcaggcgtaaggattccgcgtgcgctgcgagggcataccgccatatcgagggatgctccgagcatcccggttctggcgtctatcatcagaccgcacgcgtatttgtcagaggcggatgagacggtgattgtctcgtccggtacgcgtgcattttcgagcacccgagaaggttcgcgaggcctgtacctggggttctccagacaataggtctctatgagcgctctcgcgagcggctcgttacgcgttccgaagactacgctttcgggcattccttgcgccgtgatttcggcaggtcttatgccaacggtgtttatccgtccatcggcggtccacttcaatgtcgatgcggtcaacagccattgtctaagtacgtgccatagctcgcagtccgcttgcggtctggtgagagtttctacaattttacaccagaaaagcgcatgattagacggcgacgttgcatttgcgcccgattcatacaggagcttgtcttccgcctctaggagagaagaatatgaagatgccggccaacgtccctctgaaatgcctcgtttgataacgtccgttatgtacaataagcggtgatacagcgggtgtggcgagggccccgattgcttcgggtcgacattccgtaatatatagtcgctgaaggtataatcgaccacaacactgtagcatacggtatcgtaaggtttggactgcactgcttctgcgtgctcggcgcaagcgaagacctttggacacgatttaaattcggactcctttttacgtttccgtggcccgttctcgccgagacggaacattgcggtggagtctatttccataacagccgtgtagcggccctcgcttctgagttcgagtgacagtaaagtgcaacgagctcgaaaagattgcttaaatatggcgggactctcaatgaatcaaatagcttcctgtgcgtcacttcatatccttctaaatatttctcaaacgcgaccctgtggtgagagccgtgtagctgcgaacgaatcttttcggctcgttcccacgggataccgattttggcagttaacggggtagctggaaataagtactggtacagcatacaccgatacgctaacatgtctaaaagatagtcggccggcatcattttatggtaataaaaatgcaccgggtttccggggatggcaaagtcccgcgtaaaattcatcccggcggctagaagcacttccatcagtgattggcccagtgcgtacatatctatagcgacaccttcatcactggacagttgacttgaaccccgctccaagcccgtcccgtttaaggctttaaccagcaattcgcagggctgcgtttgcccatgccccagcactaaatcaaatacaggtctaatgtttgctctagacacttttactgaatatactcgatcggagtctacagttatgtcgaatcgggctttcgtaatggtggagtttgtgttaagtaacgccaagctaaaatcgccgattacggcctccactataatagggttagacccttccctgacgttgacgaaaatgttcccgcacttaatatccaaatgagtcagtccgcaggacacgttcaagtacacaacggctctgccgaggcccatgaacgctttttctatggccctccaatggcgtgcagttttatccatcttcctcagtcgatggcagtacgagtccatgtccatgtcatacgctggaaataccagttccctggatggtatcgaaaaggccagtaatgaaatcacgctattgagcgctagagttgaccttgcccgacaagcgcattcgccggctatcagtgtcataagcaattcggtcttgaaacactcgaacacctttttgacggctacatttgcacccttaaatactttaacttctccatagctcccgcttcccgcatatattggcgtttcttgcaggtcgatggtgctgtaatgtaagcccggggagatatcgaaaatgagcgatgttatattctttatgcgagatagagtgaaaatatgatccggcaaagatggtcttgatagcaaaatgtcagatgttttcctagatatatgtttgcgtctcctatagaattgttttaggcatctcctaatgttgacggagatgtgttgtttgtggtccttttttctacacgaatctcttcggggggcactgaatgttccctgcagatcgtctgttgtgcttgagtatcccttaggcccgctgaagtcttcttggtcgctgatgtcggaaagccatttaacgtgaggacactcgtcgttttcgcggccgcgccccggctttctggctttgaggtcaagatccattttgacagcagcgcctcgcactctgcgtccaattctatgtctggaaggcgatcgctgatgtcgtcgctgatttgcgttaagatgtcttcgtttgctagaatgtcctcttcggcacgatccaactgtgactggagcctagggtttaaaaaccttcggttcgcatctaagacgatgcggcggtccacctgttcgtctatgtggcgttggataattctcgactttctatgagcttcttcgatccgcatgttcgagtgcaactgggttttgtagtcactgtgggcgtttctggctgacgttaacgcttcgatgagttctgggtcgtccgcttctacaccttgggacaaaagtgtcaaggtgcgttccttataaattttctcccgcgttcgacactcggccaatatttgacgcctgcgtctgcgtattgtgttaacggcgaacatcgctcgacgagattcgtagtctggcgattaccgactccgtaaagatgttcggaggcgcgctcggagaatcggcgaagaagcactttgaacgcctgctgagagataggaacgagcgtttaggtgcgagccgtaaaaatgaatgcctcgcgcgcggcgggagtttagtcgacgccccctttctaaattttgcgatttcggtcccaaggcgacatcagacagtgatgcccgctgtcggtacattgcatgactgctgcgacggtactggtatttactccgcgatcgctacacgcctgctgtatgctggtatcgtaagcagcgaatttggtgaagtgcgacgcgagtcgttatctaacggtcacatatcgaaaaggaatcgggaggcgttgcttgcgccgactctgacacgcgtcgccaattccataacatttcacgagtacgacgatgcacaatgcgcggcgcatcgcaacgcgtattacagtacgatgaacactttcgggtctatgaggacatctgacgcgtttcaacagctggcgtcctttatcgatcgattttcaaaattattagctgcctcgtttaaagacgtgaatattttggacagaaataacgctcccaaacgagcacgaataaccgctccctcgtacgataagcctcatggcacgctggagctgtttcagaaaatgatactgatgcacgccacttatttcttaacgtccgttttacttgaagaccacgcggaacgtgctgaacgtttgctccgtgtcatatttgatatcccagacttttcggacgcggccactagacatttccgacaaagggcgactgtttttctagttcctaggagacatgggaaaacttggtttttggtgcccttgatagcactggccatgtcgtcttttgaaggtatccgtattggatacacgtcacatattcggaaagcgatagaacccgtttttgaagaaattggggatcgtctcagacgctggtttggtactcagtgtgtggatcacgttaaaggagaaaccataacgttttcgtttcctagcggatcgagaagtacggtaacgtttgcctccagccataatacaaacgtgagtattgcattcaaaaccgttgtgtcggatggtcccccccctatacacacacccgtgatagtctaatacacccttgaaccagtatcgaactccacatctccggcaggtagaccaaatgccatccgcatgaatttacgggaatcttcctactgtctacctcggcttcgattaactcttcgagccgttctgtaatgcacgccttcgtgccgctattaccgaccactcggacggcatttaccgtgtccatgaataaaacgcaacagaggcttttttcccctttgacttgtatatctgtctgtcgggctttcatccacatacacggacctctgcaaacacaagcctgcccgagcgatccgcactcccatctcacgttacaaacatccacgtgaaggtcgaaatgcccacggcattccgcacagccgctccggtggttaagaaattttgctagagtagcgcccagagaacgttgctgccaaccggcgggacatatagatagcaaactctcttccatcctgaggtaataaaacctgcgtttggaaagggaccaccaagctccaatagatatcgctatacagttgtgtggatcgtctggcggctgcgtgcgttggactagggaatttatgtccggtgcgatacaagagatagttgacaaaggttctatggcgacgtccggaagaccgatacaggtcctactaggagcgacgtcagaaaagaaaataagatctgcggaagatccgtcgcgcagaatgggggttatgcgtaaagcggcagtcacggaataggcgcgcgtcccgttgactaagaacaagagttgaaaagtgtttctgtccaagtacatctcctttggtcgcgtaaggtacatgaatatctccacccatttcgtcttttgcggccgagcgcccagcggtacgtacgtacataacgtaaagtctaacgtggttaatgcgaccaacacagctagacgcgattcggcccgaagcgtgcgccatacgcaaatgcggtcatttaacttattaacgaactcaactgccgccgtatcgcaagtccgttctgaacgacgcggcgatccgggcgtccttcgtcttcgcgtagtcatcgtcccacatctgtatgacgctaccgctaattgaatattcgagtcttggcagggcgctcatggaaaagataatgtagtgttgctgctgcagaggcgcgataaaaccgcgtccgcccgcgccagaggccaattgaactcggcgccggcatgcgctgctaacatgaaccccgcgggcaacacgattgcaacgcgcatacgttcatcataacctacgcaaatatacgcataactttctccaggaagaaatctttcacacgttgcgcgcgatacgaaccattcggggaatgcgcaggttctaatagattcgtcgcccggcccgccgggcgacaaatgcgctgcgtcacgcaaaataactgggataggcctcttatttaacatcatacattctccgcccgcgctataataatcaaataggaaaagattcggcgtcctagtagcgacgggttggtagtcgcctcccaggacttcggcattgtttccagtcgtatgtatgtaatatgtttttcctccagtgcgcttaacatgcctggccagaaacgagatgctcgcggacctaagagcgcctactgaaaacttctcaggcgaagaactcgcgattgcctgtagaactgcgcgtactgaatggggtgtgcggcttgcgatttctgccacgcactgaacgtctcgcgcatacacgtcgtagctgatcagctgatatagattgggccctgttttcaacgcttccccaactgcccttatgacacacgcagagacatacgacttgaaattaatcattaattcggtttcggagcccggagaaaacgcacgcagttggttttcctctgcttttaataagggagcagccaaaataggagcttccgttgcgatttcggtctttcttctttgtggtagacgagaggggtgatcgacgccttcttccatacaagcggtagcgagtaaattgctcaacgaagatggaattgtggcagaatcggaggaacggccccctaaggcaatcgaccgctcatacgatataagataaagtgtttttttggtcatggagtgggtacgtggaacgatggatatgcccccgcacctccaccggttcgcaattgtgagcccgtccgccaaaatgccgaccgcagaagataggaggtctttggggcttaacgaattttgcgatggttcatcgaacatgagaatgtcttccaaattcaatgcagtccctgtagattgctggtccttattacggccctccaagcccctccgagtgtcgtggtttctggcaaaccttcctttgcccacgggctcgagaccatctatgacggctttctgtgacacgctgctactgggtgtgcacaaattattttccaaacaagctatcgccccttggcgcaatccggacactacgctggcgtgtatattctccgccggccgttttgcgcttaccggcgctcgcctggtgatagcctcggctgccttcttaatgagatttgcgatctctatattgtctgtctctagtcgcgtgtcgagagtaggagtgtcgaagacgttcggagaatctgttacttgccgcataatgtcaaactgaccgggcagttcgacggcggataaacacgcctctaatttagcccccaattctataacagccgacggtaattcgacctcgtatctcttagtatatcgtatgaattgacggaagagcgtctttaagcggttcgcatcgatatcgtatcgagtacctggaggaactaattcctcttgactaaacagtaaatccatgtacgcttcgtactctccggtttccctatcctgtacgttaaagcgaatagccacggatgtaaacggatcaaagcggttcttagaatcatattgtatgggaagactcatgaacaatccaccttgatcgtttcgattgagcgtcgcgaaaagtttggcgtggcccgggacatgaggtatcaagagtatgtgtagtgcgccagagggaacgtaggctgccggtgattcgcgccaaccggaacatttaccggtggcattatagcgcatctgaacacttaccggaatcggcagcgattggtaagcactgctgggtactctctgtgccgcatccttaaaacgggcgatatctatccccgctgccgacaaacactcatccggtaagaggacatgcgtcagtacgtgccgattggggccgtgtttgggagtagatagcgaatacgcggtctcgctctctatatgcgcctccatcctgcaccggaatggcgagtcgggtcctgcggtctagatagcgtcgcgtcgccgttaatgcgaggggctatgcctttacggaccctctcgactcagcattgcttgtttttgtttctgcagagcattcgcggccaagatttcaacttgctctttgtcgacgaggcgaatttcatacgtccggatgccgtgcagacaataatagggtttctgaatcaagcgaattgcaaaataattttcgtgtcgtctacgaacagcggtaaggcgagcacgagtttcttatacggtctgaagggatcggccgacgatctcctaaacgtggtgacgtatatatgcgacgaacacatgaaacatgtgacgaattatactaacgctacgtcatgttcgtgctatgttctgaacaagcccgtgttcattacgatggatggggccatgcgtcgcacggctgaaatgtttctccccgactcttttatgaaggaaataatagggggtatcaccatggatagaaacacgtgccagggagaccggggggtttttactgcttctgctgttgagcggcttcttctatataggccgtcgactgtacggaatcaggatatcctctcgcgagacttatacgtgtatgtcgatccggcgtttactgccaacaccagagcctccggaacggggatagccgtaatcggtaggtatggagcagattacatcattttcggccttgagcactttttcttgcgggccctgacgggagagtccgcggatgccataggagagtgtgccgcgcagtgtatcgcgcaaatctgcgcgatacactgcgagcgtttcggaacgataagagtggccgtggaagggaatagcaaccaagattcagcggtagcaatagctactagaatttcgatcgacctggcctcgtacgtgcagtccggagtggcaccggcgccacacgacgtttgtttttaccacagcaagcctgccggcagcaacgtcgaatatccctttttcctcttacagcgccagaaaactgcggcgtttgatttttttatcgcccgcttcaactcgggtcgagtactagcttctcaagatttggtttctaccacgattagcctgtccaccgatccggtcgagtatttgaccaaacaattgacgaacctctcggaggtggtcaccggcgcgacaggcacaagaacgttctctggcaaaaaagggggctacgacgataccgttgtggccttggtaatggcggtatatatatctgcccacgcgtcggacgcgacgttcgctcctataagaggagtcgaggccacgtgtcgcggcccaacagaagcgtgaccggccccgaagcgtgaaatatatctgccgcgtcgcaggaaaagctaaccaataagcagactcgcataagcacaaaccgtttattagaaggctacccgatgaataaagttattttaattccagttagaaataacgggacataggtctccgacttttatactcgcgggcccgtcgaacgtgcacactttcaatagcgggcgcagcgctagcatgtcccctagatgcagagccatggtaatccacgaagacagggcttcgtaaatgggatatctgcgccacgcgtcttgcaaaggcgggggtctcggaattctgatgagctgacctactgctctcgtggccgtctggagacccaccagggcgttgacgtaaccgtcagacgctcccaaagtaagcaacgtcggtatcagagcatataggagcatgttaccttcgtcgatagcgaaaatcatgtttagcaataaggttctcactgcagactccgacgcatccagactatggagcgtcggactaatggtataggttttcccgttatatgtaatggattccgcttcacggctcgtagggggaggcgctagccctccgccgatcgctatcccttccgtggctcgagatagcgtcttagcaataatttcacgtgcgagtctcgccggaacggttgatggaaataaaagttcggtatcgatcgattccaaccggatacgggagcaaacgttagggaaaagcggaggtatcaggcatacagcatccccgttacataggtcgaacgggccggtgttttgaagtgccaggcctgaaggaatggtccccattcccaaaactacagcactcattcgaccgggtagcgcgcgggtgacgacggccgcaaatcgtcgtttgtaggtcgatagcagactcagcgtatcaggttcggccccagcgatgtagtatgacttataatctacttctttgagcagcactctggctctgacggacggtaaaaaaagaactcgcccctcacatcgttgaagtaggttcgcgtcgcacgtagaaagcccgcaggggagctcgatctctactgtcgtaccattagaagcggccataacggtaccgctggcggtttattttcggtaccgacggcggcagcggataagtgtataggaaccaggccgagccgctgtcaggtcaagcacgtagaccgcggaaggttagcgatcggcgagctggcagttcagcatgcaggcaagcatccaccgatcggcgaagcgtctttgattaagtattgagccaagtgcgtttctgggttatccgcaccccctgcgaaatacgtgcggagcaaagctttgtcggtagcgcaaagtagcggataggcttcctgaaatagggaacaaggatcttcgattaattccgtagatccgactggtcgtttgaactgtacttctccgtccgacgcgaatgctgccacggcagaaccggcttcgctgattagtttatccaagcaccggcttttgcagcacacttctgccggggtaaaaaatttataggtgggactgaagaggggagacgccccgctcaaattgtaagttccgttatagagcttgtccgcgtaagagaatttttgcgaagcccacggattgttggttgcgcggaacggataagcgggatccccctgccggtgatcgtacatgagtttctcgatatcggatacttcctcgtccgaatgtatcgccccggccgccctccctctcgggttacacggggttcgaaagtactccaggtctgcggaaacgggtgtagggatgaactcgcatatggacatttggccatgttccagcccgtcggggagcatgggcatcagtgtacctagaaaggggacagttctttgcggagctgttctctgtccgcgcgttgctgctttccgtagaaagtcatcggcttcggggtttataagggggggcgagccccgtgtcaaatgcaggctttggacagtgttccccatatccgtcgtagcgtttcgtaagagtaaaggggtacaagtggccgtataccccacgcccaaatcaacgttagctcgtggttgtgtcagagaaaactgcaccccccctgcgtgcgggcgcttcgagacagacacctgtccgagaaaaaacgattcggacgcccgttcggcaaacaggcccatatctgctaggaacctatcttgtcgtacgacggtaaatgcaattcccggatggaaccccgttctcaactgatgatacaggcctataggagtgagtttgaaatatcctgccatcagcgcgtacgacatttcgttgggcccgcatctactttcgcatatgtactgtgccacgggctggcggaacgtagaataataattggcgcccaaaaactgtggaacgggaggagctctgccgagcagcgtacgcgcgttcccggccaactccccgactgccgttagatggtcctgacaggcgaacaaagcgttaactggaacgggatagaagtacgtgccggcagcgatcgtctcatcattgcatgggtaggccatcattaaaagcccatggtgtaacgcgccatcgaacgttcgcatatgccttgtcgccgatgacgtgccgcctacatccggggtggttccgtagagaatcgccgttgtccgctccgccatattgttcaccgtttcctgcagagttagaagcgcgtccgcatccaccaatattctggcgttgtgtagcagcacgttaaacgtgttggggacaagatttctagcgttcaacgggtgcctcgggtcttctgcgcccaggggaggctcctcgtcgggttggatgtcgggaatgatcacagattgagacgtagcgtagatgttgtcgaaacggatgcccatggtgcaacactgacccctggaaaatgccgggaccatcacgtaataataaattttcgataggattgaccattcatgggtatgatgaggcgcgaacgtttgtcgatcggcgtctcctacaggcctgttatggactaaaacgttgccggtgcgttcaaaatccgcatcctgcaattccagccacggccgcacagcgtaattttcgtcgcttcccacgttcaaatacaagtttctatcgcgcacgccgtgcgcttgatacatcagggggtcacagtcccacagtagggggggtaggatcgctctatcgattaaggcgtggtttaattcctcattactctgcccggtcagtgagtctgtctgaacggtataatcctttacaatcgaccgcagcgcgcgaacgtgccgcatcagctctttgtagatattcgtacagtcctcagggagttcaccgctgcataaataggtatcgatgaatgcgaccatgtgaaagttattgacgaatgctactcgtttgcagttgtcccagtaactccgtatacattgaatgatcagtcgcatcagtataccgaaattacgttcgctgccgtgaattacggcttcgattacataaaacgcagtggggtagctaacgtctgagaacgttgcacatacggcattgattgtggaagcgctcattttgtggcgactggatgcgagctcttggccgagcgcatctctaaagtcgctactgcagagaggtagcggaatattacagttgcaaacccgccaggaggcggcgatcgacgccatcacttgcggaacgttatgcggccccgggagctctacatctcccgggaccacaaaaaagtcaaacgcgggatgcaactccatagatagatgtggatttccggccgataggaattgctcttgactcatatggcattcatctacccaccggggcgacccgcagagcacgtctccgatgttctcgaaaaaccgacggctagcttcccgtagaggcaaggccggcgggttcgtcacatacgccccgaaaacacacgttaaatcgcgtctgtcgcgacgtaaatgactaaccgtcgcttcgatatccaaaaaggatgagtggcacacggttccaatagcatccgataaacatacgctaattatctggttgtctttgttatggaaatatagctcccgtggcgggaacccgcgcacatctccttgacatccaggcccgggcgcatagtccccaatatgccgcgcataacggtccgcccgtttctgatatagtcccaaaggcatcacgaacgttaaatctatgtgtccgattaaagggtactggacttgcgttgcttgataaacgcgccgttccatggcttctagaaaaattaacttatccccaatggtcaccaattccgcaggcacttctgccgtttgggggacatcgtcgtctccccgtacgacttcatctgtacgatcgatgatgtcgttttcgtcgagattgagaatatagcgtgcgatgtcgtccatgttgcgtatggctttgcccatcactacggcggttactaggtttgttcccgatattatcatttctccatatgtaacgggcaccctagcagacgtatccgccatgtctagaattcctgatagcagtttttgcctcaccatgctcgttgttactagtacgccatctacgaggcgccctttcgaatcggaatgggtcagcctcggcattgcaattgtctgatgagtagagttaaccatcttggcgaggaatgagactatactgtctttgctcgcaccggctttgctcatgatgaaggtatcgttacacactctgcgtttgagctctgataccaaattcgctcgcattacctgcccgtttacccttccttctgtcgtgctgcgcgaaaggggtatcagtagcggagtcggcggagccttttccatcagtattctaagcatctgatcgaccgtgccccgctcaaacgaatccaatatcgttctcacgtttcgagctaattgctgtatggctctcagtctcaggtggttagatattgccgttccatctaaagatacttcagataataatgcgagtgcttccgccgcaacgacaaaggccgcgcttaacgatcgcttgcatacgcgctttaccatgtaagtgtaaagcggttgatcggcaggatggggcccctcgcgcgcaatcatgggttgctgtatttcaaattgcacggttccttcgcgcatgtatagcagatcgggagcacgcgtgcagacgcatgcgactgagagccccgtttcgagaaatctgatcaaagacaatgtattgcagtaggttccgagaagaatatcgaactgggccgaatagcgtccgttgtcatcggaactgaattgtttgaaatagtcgaacatgcatcgatgggatgtcatttctatagcagtcaggagtctacctgtaggcgctaacgttgctcctacgttgaatggtgtcgaaattgcacacggtgcgattggcggacagtcggtcgccggaggacagcggcatccggccatggtcgtcaacgggccgcgtccgatgtaaggactaattgccaccgtgactatccgatgctatgcgtgatccagggcatctagtaacgtttggtcgcgtcgaaggtcacgttaccggctgttcgaatgcgacgcaaatgatagccgatattgtaggagagacgtgacgtggagaatgcgcgagttctagcaacacgaacgaaattgcatattagactttaacgatgcaggtttttatctacacaatgaagtcgcgagtgcgcgtgcccttatatgtgcaagtttccgcccctaatcagaacggaacgcacgtctttatcagtgctcgtgtccacaaacgagggaggagaaatcccagtgcgtccgacacagctactgtagcgtaggtgatggtagctcccattaacaggtataccacagctccgtctgtcttatcgttttcctctaattgtaaaactttctccatgaatctcggatcttgaaacaccatgcggtaagaaaatactccgaatatcaccgcccccaacgtagacagaataccaacgaagatttgctggcagttatccataggcatgacatcattctttatgtttctgtacatgtaataagtttcgaggagtaaggtaccatagaacactgcggtaatggtcgcgcccaggatcagaaaacgattgtcgtgcccgtccatcgcgtacaccagaaatataatacaacacgagggtcggagaacaaatgcagatagccaagagagcacaacataccgagtaaatttggggttcatgtcacagcttttcgaaatagtgaaaattgaacctgataagtaagaggacatcgtggcatactcggccgcatcttcgcaatcgatatcgtccgaaacgcgtgtaactattgactccgtgtcttgcatattcgtctctaactgttcatcgccaatatagtcgaggagaatatcgcaatcggtcggttttgttgtatggtatccacgcctgtaccaaggcatagtgccactcgagaaggaccgtttctggccacacgtaacgactttgtcttctactaaagaccacccggactcggtacagacccaagctagagctcgagaccgcggaaaatggatatcaaatacgaacagaagatcttgtatagaaacgtccacttttatatctcggaatgcggccgcatagcttatttcttctgcggtggttgtctcatggcggtcgggcgaccgcctaccgatgactcgcaggcagagtttgcaaaatttgggctggctcttcgaggcgatggagagtctaaacccttggcagcttatgtacggcgggaattgcttcgtagaggaatgaaatgggcgctgcctcccggcgacgatgaattattcatcgactgtatggcctttttgaatctagacggggcgtgcagtgaacgtgagatttgcgatcttgtttgcctggaaacgtatgatccggagatcacaaaacacatggtatccacgaacgtcatttctggattgttgatccagacggcgcatgagtcgccgcgggactgcgtgatccacctgcccggggccccacaagttacagacgcacattccaatgctgtgtacgaatgtaattctggtgcattcgtgctaacttgcgcaactttggtggaactgcccacgtctctgaacgatctcgtcgaagggttgtttgacggtgtccccatccccagagatgcgctctcgtcgaggtcgcttagtagacgaacgaacgtgattatcacgtctaccaaagccgcggaaacgacgactatacagcggatgcatgtcccgcgacataaacagaggggcaacttaaacaccatcgcagctactttgcgaccggtgaaaaaacacgcgcggtttagcccgttcgtgcaagtaaagtatatacctcgcgtactcaaaatatggagttgtgattcagatagccattcgccgtccctaaaggagttgcgggaattgttttgtaaagtggacatggtccgtagagaaaacatgtacgcagaatcgcaattggaaccagagtccgtcacaagtgaactggttctgatagtcgatactgtatttgggagaccgctcgcaccatttattggcgtcgggtcggaaaacatacgcgtctcacatttccaaaagttcttactgctccagggcgtccttatattaaatcgtttgccgaattgctacggaccgcttcgggagctgtgcattcagcatgcacctgccggtgaagagtcgcctcctctggtatccgactctgttatcgcagacatggcgaaccatatgtttagggtcgccgtatttattggcatggttgtggaaatagttgcgggatgtgtatcttttgcatcagaagaactcgaaacgcgatttcccagtgcgaccgcgtttacggatgctggcattctactgaacggcatagaagcctcgccgaagccaaattgcttgtcggaacttaaaacacgcaaactcgctcttatcctggacggtatttatagagacatggatcctatagacgttgctctacaggaatcggtggggctaaatacagcagagttattatccgcagcaatagatatctcggttatgtctgcatttgagcattcgggatggtgtagcggctacatggaacactttgtttcattgctagatgcccgtctgagagagggagggtgcttggcaatattccggtagctttgtagcacagcggcgagacgcgcataggcgtgccgggcatatacagaacgtaagccaagctggagtttgtgtaagtatgtgctctacagcgtgcgggaagggcggttcgcgaataaacacaacagtacaggttcgacggttagaaagtttccagagtttattaattagattggcccctcaagatcgtctttgcgtcttaatttctcatatccatggtacctaaagttgctgacaagcattttggcggtgacaatcgctatagctgcggctattagtacacccgctgcagtagttgcgatgtaggtcgccgagaggatggcaatgcgctgcgactcaaacgctaggatcctcacgactgtgccatttggatacagcaatagtgacgtgccatacaggttactggtggtggggttgaaatagcgcacggacgaattgcctgctgctagcaattcccgctgcaaatcgcgcgatgagatataaatcgcatgtcgaacgtggccgcttgcggaatatcgcagcagcacgcagccgcaatacggacattcttttcccagaggcctaggtaaaaccgcaggactgattatacctgatgtcgacgtgcacggcagcctggcatatgttatgtaaagttggttgtttacatcaacgccgtctacggtatacacgatccctctgaccccggcccgccttgttacaatgtagctacctataccggagatgggtaacaccagaagagtgtcggattctaacctatcagtgcccgaacattccaaaacctccgacgcgtatgtagcaactgttctccctattgatgttcgcagctttgcaattactgattccgccttggcctgcagatcttcttcgattctgaccccctgagaagtattctctaaatactcctctattactggacggtaaaccacattggccatcgcgtataccctgtgacgccgctcggaaatgtcgatcctcaatgatgtcatgcacggcgtatacgcgtccaaaatatgtacgggctcagtgctgcgagtgagtctgatatacatgtcttgcaccgttaattcagcggccgcgatgtgttcttcagtacacatcgatgatgcaaataacagagatttgcgtgcgttatgcgatgcgcgccattccatcggcgaccgctgaaaaacgctgtcgaatgcataatacagggcgtgtctcgtggaagcattccacgagatcgcgtccctgacggattcttcgtggagagacgtgataaaatttagtgcgaggtcggaaattcgcgccccccattcgcccttctcccgaggtatgtcgaacgcgtacacggaccggaataggtacaactgtcgcgcaatacctaaagaatgcgtccccctcgatacatcgctaattttttttttcaatacggatgttagtatagcagctttttcattccatacatgtgtccgcgataataagaagcacgtgccggggtccgtgctcggggcaaaattgcaaagtgccgcggcgattactttcagatctgcctcccttttaattaattcatcgagggagacgtagccagacttaaaagcggcgtgtacggacgcaacaagcgccagaaacaaacgcgtcgttacgatcctaaagccgtggatataattactagtagatgcgggcatagaggcagaaataaaaagccgggagtgcgcttgagtgatatgaagattataatctaataggtcatctacactcgaaaccatatctgcgtgggcctttaattccatatccgaggcgttctgatatgttcccagtaggtatgtcgaaaggagatgtcgagaggatccgttcatcgggtcatactgcttcatcggtggccacagcaaagtcatgttggtagtccccgacgataatattagttccacaggcgatgcggcttccatagagatcgtaacggaggcgaattgcactcctaccttcattaagacctccgcggtatttgaaccgaatatcgtcgtccgcacgtgggcataatctgtcgggactagtgtgtccatggggtccacgaagcatgcacgctttgcaaaagctcccgataattcgctgttgagaataaaacggttctccggagtgaagaagtcattcggctttatattttctaacactgttggcgggtttgcgccagtaggttgtgacttggcaccaccgtgagcttttggaccgggtttgtccggtgtctttttttcgtctcgtcgatgggataatacggctgccgtcaacgagtaatcgaggtccggcttcgcgttcaaaactttgatcaggttattagacgttagcagcctagatatcggtcgtttgaagaaaaccatttgcttcacttcacttattggtaaatgaaagagaatgccgctcgccggcgtagatgctcctatatatacaaatgtcgcattgtcgcgtacccaggacgtcgggctagtagcattttcatcggccgatgaaaagtccaattttacggacggcggtctccggatgtctagcagcgaccatacggaggggatattatccgaggtgggggctcccggggaagatgcgagcgctagcagtaataaggtgcataccgccattccgattacgcggcgtcggtcgttgcctctgcgtatcgctagttcgagctcgggtttccgaagcaacgtaacacacatatcctatagtgtacaatgtttcgatgcaactgaaagcaacgagctaaagcgaagatgttttgcaggcgacaagggcatgcattaatgcacactcgtccgaaatgtcgtagtctcaaatgtccatctccttattgaatgcctgaacgtccgcctcgatctcaaatacatcattccagctcatatgcgttattaatctttccgccattgaatccataagatactctgcacatttctggaccgacatgtcgctgacatcaagccgctcgacattgatgttcctcagtttcatcaacatcccccacaatatccacccgtataccgttaacaggctaccatcttcactgcataattctttccgcttaaaaattggcaaaagcgtgtgctgcaatgacacccggctaccatggtaacctgaacggggaccatctataaatgtagaggccatcgatgcatcaaaccacgggagctgcatccactctgtttcccattcgtctttactgtaaggacaaatgcaattcgcatacgcgacggtatctgctaaagccgaatatgccgcattgagcgccctgagcatgcgcacgtctgtagtttcccccgctctgttcctggccgataggcgcttcaggtgctcggtttcgtcgggcaaatgtgctattaccaagttgcagccgggcggttcgtggggcaaccgtgtaatcgcactaatcaacatttccagagaacaatcgccaatcagatgtcgggcgatgggaaagcagacggtagctgaaacaggatggcgatcaactattaatataagagatgggttgccccgtgttccggctaattgatgacatttagatgatattcgttcgtgtagtacaatgaagggatcggcaaatttggcctgcaaagccattacgatcatgctagactgaaatagagataattctccccgacgccggcgttcggaagcgtcattcacagctgcaactaaatcggtaaaatagcgacgccaatatttcagaggctcaaaaactttcagcacgggtactcccgtcgcagagtggctcggcacttcgtttaacatcgacgttttacctatagccaatggcccgtcgaggtagacgcggatcagctgcgcggatgtcatctgagagggcattaccgaccacggccgcacgtccgacatgtccggcgcgcaagaaaactgctcgtagacgatataaccggcggagaagcacttctggacgctcaagttaccgtgcggctgttaacctcaagagaactctagcggccggcgttcgatgtcacgcacgtttttaccaaaagctctacgcagaatctatgcaccttcgaactcaggccgatgattggacggggcgggccctatctaagattttaggaaaaattatggggtttgatgtatttaaagcggcaactgatttccgattggtctttgaagtaaatctggggcggcgaaaaccggactgcatttgcatgattaggtgcccccgcggtctatgggaggcaagttgtgatggcgcttgcgtcatcattgagttgaagacttgtaggttctccaataatctaggaacggccagcaaaaaggaacagcgcctcactggaacaaaacagctcttggattcaaaattgctgattgactatttagcgcccgtaggttcggagcgtattttcatctgcccgttactagtattcgtgtccaggagaaaattaaacgtgttgcgtgtaacctgcctcagaagaaacgtcgtaagtaccgatttccatcgtctcgcaactttaataacgcttgcatcggaatataagattaaacaggtcgacaggcgcagaacggctgttcggaaaccggctcagtgtgcaagaaatttcgcaagtcttgagaacgcgcggcgagacgatcgatcggaagaggtcgagatacacacttttcctaactgtagtattgtcctaccacctcgtaccattctacccggagccgcgaatacgacaatgcaccgtttggcaagtattgttagctgcttggtacggaagcagtaaccgaaatcaacggcaccctacgaccagctatgttacacggtgcaatccgcggcccttctcccgttactttcttgctccgcagcccttgtccaacgtcagttgtccgtaggcactgcagcaaagcatggcgagctttgcctgggatgcaagaattttgacagacccgggcccggaatctcacccggctgatgtaaagaatttcatagcacctccctggcctctgcacttctggagggaacctatatttagcggcaatcttggggatgcggaacggcaactggcaatcgttaaggcgcgaaacagtgccgcgattgcagcgttaactagtttggacgaccgtactgatttaattgcggtagaagtggagcgtcggcttcgaccactagaagataaaatggaacagatcgcaacgactttggcggatttggaacgagctgcttctgcggctgaacttgccgacgccgcagccgatgaggctcaaaatgtcgtcgattcgaacgaatgccaaaaaaacattggtagcgctgcgagtcgcgaggtccaaatagtcaggaacgatccgtcgctaagatacgactctaacctgtcggtggatctgctgaatattatctatgccagcaggggcgctgcgaattcgggagtggcgttcggtacatggtaccgtactttacaaaactcccttattgcggaaaatcccagcgctgcgcggaagatagattatcgcgatggaagaatgtcgcggaccttcattgcaacggcgataacgtccttacagtcatgtgggcgcttatatgtggggacgcgtaactattcttctttagaatctgcagttctatgtctgtatgcgttttatacaaaaacgggagctaatgtgtcccatccaagttcttttaagagtgcattagaatctgttcccatttatctggatcacatgtcagcgagcctcgctagcactgataccaggcaaatctacgggttcgataccgggaaattgccgaaggatagtttcgccgccccgtccggaaaatacgaacggggcgcgctaagtgatcatagcgtattgagagctctagcaaattctcgcgtgttgcctcctagtgcggggtcgatcccccgtggagacgtagccccagagctagatgccgaccagagcgttcgtaacgacgaagtcaacgctgccgccgcagcgctactgggacgagcccaacccctcttccttatggaggatcagacgttgctgagagccactttggacacaatcgtggcattgcttttacttcgccgtctactttggaatacgaatatatattcagctagagttaaaaaccagttccaactgggggcgttcgttccaggcgtgcctccagatttaaccgtaggagcctcagtagacacgccgggggatgtaattaagagtgacgggagaaacttaacctttttatttcagagatacgtagttcccgtatatagtgttgtcaaagggatagagctcacacaactctttccggggctggtagcgttgtgtttggacgtcccgttttccgatcgagggttatatagcaccaggacgccgccatcgcgtatcattgacgtttcgctgagtaaatatcaggcctccctcgtgaaattgatttccttagagcttcaaaatcgttcccgcgctaatgttgtatctgtttgcgaggtgatcgcgactcacgatttggtgactctgcagtatgagcgaggcttggaatcgctgatgcaagtccagcgtccccgcacccgcttttttgaaaccaagaaggctttggcgttcaatgtggaaacggattacgatctgctttatttcgtgtgtttagggtatattccgaggtccgtatctgcatcgtgaaatatacgcaaaatattggcacgtgtccagcttaaacaacagtttagtagaaatgaatccgacggagaaatattcctcggtatatgtcgccggatatttgtttttgtacggtgcagatgatggcagcgaactgcacatcgaccgcgaggatattcgagctgcaattccgacacctgctcctttgcccataaacatagatcatatacggaactgtaccgtcggagccgttctggcactaacggacgacgaacacgggctgttctttttaggaaaaataaattgcccggtgatgatacgcacgctcgagacggccgctagtcaggaaatattcagcgaattcgataatctcaaaacagaggagagggtattgtatttgataacgaactatctaccatcggtgtcgttatcttccaaacgtcttgaacccggggaaaaggccgacaaaagttttctggcacacgtagctttgtgtttattggggaaacgaatcgggactatcgttacatacgatcttactccggaaaatgccattgaaccgttcaggaagctttcccctactaccaagacggccctactatccgaggggcaagaaacagagcggctcttaggcgataaggtctggcatcctagtaaagaggcgatgtcaaccgcgttgttgggcaccgctctgaacaatatgttattaagagatagatggcgcactatttccagccgaagacgcatggctggtatatccggccagaagtacttgcaggcgtcagccttgaccgcactggccgagtcgatgacgtccaataacgcatcaacgatccatccaatcggcgaaaccgcaaactcggacggcatacaaaaggatgatcgaattgaagtgtgcgccacttcgccgcaaacgaacaaaaccttagagtccagagcattttcgggagggagtgggttcgccgggactcatgcgatctctccaccgccccagatgagcgcacaatcgccaaccgagatgtctatgaatactaaatctcatttcccccccggcgacgatttcatttgggttcctatgaaaagctacaacgaactggtgtcgagacaggccacgcacgcaattaatgcccccgaagctgcagtggggagccaggcaccgtatagttcctctccgttaatgattccggcgcacttgggacagcatgctcacattgggggatatggacatgcctccaacccgcaatttgcatcgggggccataaattacatgggcgggtttccatatgctctgcctatccaccccgttccaaccggccaatcgtctttggaaaccaagctgtcggctctactggattgtatgacgagggagaaaaaatcagtcgatggggatcgcggacgtgacgacatgttctctggccaagaagaacgaggccggcgcgggcgcaagcgcccgtacaactgtgacaaatctcccgagcaggaaccttattatccaggcgaattccagcagtccgagcatcgtaacttaagatgcgaagacggcatcgaatacgggcgagacgcgactcaaacgaggcccgccctggcgggcctcgtgaacgctgttacgtctttgcagaaagaagttgaacggttaaacggaagggcgcaagcccattcgataccggccgtacagcatatgcaaggaatgggaaccggattccaggcccccgtatactacgcataccctcctctcccaataccacatgtattttcgcggccgccagaagacggccgcccaatttcttccggggagggaagggcctcgctaggtagcgccacgggcactcctccgtctggatcggtacctccgaacgcttctcaagaacgtgtcgatgcagctcctaaaagcgacaccgttcagtcgcaagatactgtgaacgccagtacgatcgccaatgtacatcgcgccgacgatgcaggcgcggatattttcattaaacaaatgatggcttaaatgatggcaggggatccgctatgtcgacgtataagtttatacattttgcgaccgcaatagcaaataaaagtaaaataatcgtatgcgcacgtgagaatttatttatcgagaaacagcatcgcgctaaacggcatcgtcctccgaatcagagtacacaggcgataatctatcgtagtgctggccactactttttagcctcagctttgttaggtgattagaaagaatagcagtggtgcctcttgtttttttgcgcaaatcattttcgtggcgttcctctgcggacaccaacgccatatattttatcatttctcgagccttctgtaatttttttttatcgattggtgccttttccgagtccggttcttctccgtgcaactcgcgcgttgcctgggactttagctcttccgtcgtcactggatatagggctttcatcgggttgcctctaagcttgtttacgtaccagtaagctagaaacgcagccacgagtcctgctataattatcaatcctaccgctaaagctccgaacgggttagacataaaagcggacactccagatacggtagccaccacggcaccggcggcacccacaacgaccttccctatggcctgaccgacttgccccataccgttgaacaattccgccaggccgttcataaaagcgtaatttgtatctacttctattactttatttatgtcataaaattttagttcgtgcaactggttgcggcgagccacctcggcatagtccaataccccgacatctcgcaactcctctttcgtgtagaccgacagaggaagaatttctctgtcttctaacagtgttaagttcaggtctacaaacgtgctggctgtctgtatatcagcaacctctaccatcttaacaaagttatagtcttcgaacagagcgtatgcggatccaaacaggaagtatctccgctggttagccgtacacggttctacggcctccagtgttgggagtagctcgttattttcgccgagctggccttgtatcctcccctggttctcgccatacgaaaacaagaccagcgggcggctgtagcacatattagtagacgtggcgaccctcatggaattctgcaatgttaccgattccgcgtcgatcccagtacaagtagacacggcggtcacatcccctaacattttagccgctacgcgtctccctaaggtagcgctcgcgatggcgctcgggttaattttcatcccttcctgccataaagccagttctttattttgtaattcgcaccaggccgtggcgattcggctgaacatgtcgttgatatgagtctgtatatggtcgtagagaaattggagcatggcgaattggacggacgaagtagatcttatcgtagcgccttcgttcagcgccagtttttccttcggcgcattacggagctctcgccgcaaacgggacaaggagacatttgttttattggaaagagcatgcttattatgtactaggtctagcagctcgtctgtcctgttgtccctcatcagttctcttagatacatgtgagccagagatttcgacataacgggctgatacgccacaagaaatccaccgagggccaaaaaatattggaccttcccgaccttgacgtggctgtcgttatatttttgcgcgaatatgcgcttgattgttgtttcagcgtcgcgctttacgcactgacctagcctgatacgatccggatcgaattcagtggtattgctgataaatgttgacgatagctcgcgggccatgaatctatacttgccgttaaccgttgcgcgcaacatttcagtaacatctttccatttaaccatcgagcatacacgagcggtctttgctgcccagtcccacccaaccgtaaaatgtggagtgacgaggaagttacgcttgacgggtatgctcgccttctgacgcttgctcagatccattgggaaatagccgtctatctgcctaaattgttctagcggatagcccatgggttcggcggcggcctcgggcggggcgacgccataaaacggggacatatttgcgatatctccgttcgccattgcaaaatacgagtatgggaatgcagccctggcatccatttcttccactatgcagttgacagacgtccccgtccgatatacccacggagacccccatacggtataagtgtcgttggtcgtatgccacgccttggactcgggggtgttgaattttgacggttgtagaagtacctgtttttctccggcgtcgccgtcgtatgcctcgacgtatacattgtttctcaggtatcgcgctttggaggaacatctccctttcgcgtcgattacatccgtaatttcttcgatggaaacgggagtcctatctgtaaacctgttggtgatttgtctgtacgtcgtcccggtccaggtcgtcgtttgtataacgttcttataataaagcgtgactttgaatttgtatgggtttatattctctttgaagagtatagcaattccttctccccattcggtggcctttagcggttcggggcattttcgcggcggttctaaccggaccacggtcgtaccgaccgccggtgggcagagaaaaaatgaggactcgtcttcagacagctgtacgctcgagactgcttcccgcgacgttacgttttgggccctcgcgactcggccgaagaagtagaaaaccacagatatgaaaagtggaacgcagatcccactgaaatggttcattacgggttgatcttaacgagtctcatcgatagtgtggaaaggcgcgccgcggtacgaaagatatcgcactggtcaagtgggggtgtggtcatggtttgttcgttccgcacgtatctgatccgcagccgcgggagccatgtactgcagaatggaatagagcagcgagaaaacatccgcatcaaggattacggtcacgttgtctgattccgcaccgaggaccgttatgagagggcattctgtttcatatgtgacgtatattccatcctcccatatgtattccacgttaacattgagcggcaagcaatctgcacgacgcaggtgcaattcaccgcagctgaacgcggaagaaaataaagttgtcgccaaaatcacctcttttatatatttccaagccattctatgggccgcggttatactatctatgccgtcgaagtcgtaaaaccctctgaatttactgacgatccagtcagacgaactgcaactatgaatcataaatcgcgctatttcctccttcaaatgcggcaatagaccaacgttctctacactgaaatatagcgctgtattcgaaggttgggcgaacctatgtacatcgtgattaaacatcgggccgtttaacaaccgaaaaaatttgtgagttaggctggggagcatcgcgggatctattctgtgcttaagtaatgacgtttgcatgaaacggtgggcgtcgaacgcatcagcggtgatgcgattatcgatgatattcgtacatcgtttcctaatggcttccaataacctattcctggagcggaacccattgaataatgtcgtgtatgagtctatcaatatttcaccgtatacgttaacccgcagcattttttccagctcctttctttgctctgtaatacatttatccaaacttgcgagggatcttttacttaggcgctctgcgtacattttgcgtctccgagcaacgtcagccgatgccgatcgtaccaactctaaccagtcgtagtgctcgcggacatcgggtaacggggtaaccccttcgcgaatccgtagatgctcggagttactaaaatcgtcctcgggcgcgccgtcgccgtcctggcataggggaccatttctcgtgctatgcgaagtcacttgttctaaagtagtcttcagcgcgtcttgcgccgcctcctccgggtacaataaacgttttagcagaggagtcgacatatgatgatcgtaacatgctcttatcagcgcttctatgatgtcgtctggcgctaccgccctaccccccagaagcaatctgtcggccgcattcatattctcgatttcttgtgcaaacacccgttcgaaatgatccatgcgccgcccgaataccgtcatttccacgacggatgttctcagatcgaaaagacgctctttgaatgctaaatcttcgaggttgtccgcaaacgagtcaatcgtgtttgctctcggttggttaggtttgcgttcggacgaggcaatccagaattgcagctcgctaatggcatacagattccccgatgccggcaaaaaaacgttatgcgcgtccaggacggcggttgccgcatcggcgacagacactgtatcgccgctacctccgggatccttgtctccccttgtcggtctaatgagcgaaagtgccgcttgtacaaccgaacgcttttcgtcggacagacaagcggcatgtgggatgtgcgctaccatgtcatctgggtggacgcggagaacgatctgcttagttacatgattacatatttttccgattatgcgcttatgtgccgagtctccactgtttgccgtcacgcatagttcttcaaaacaaacggagcatggttgtgacgggtcgcacaactccggcgaaacgaccgatcccgcgcccagagtttcgattagatatcgatccagggccaacataaagttttctgcggttcccgcttttacgattaggtgacagtaattgagttgcttcaatatgttttctacgtcgtgtaggaatttaatctcggtccgcaccgaaccgccgtaagtatccaattcgacgacttcgtgatacggacagtccccggatatggtcatcgacttaataaaaaagccgtgtacatctccggtgtctgtaaactcgcacagcgcacgcagcagcacttctccgtctagtcgagctctacgcagagctaaccacaaaccgtagctaaggggactaatattcctctcgagttgctccgtcagcccaggagccattaggttttccaaatagcgtaccatgagcacatttaatttcagcggcttgatcattcgcacacctactctcggatcgcatctcttcagcagctctacttgaaacaagtacgattgcaactgaccccatacagcgagcagtttctgactagcgaatatactgtctcgctcaacgtctagcgcttgtgcgtttccgtgaggcatatccaacgtctcggttcgcctcgtctacgctgaattggacctgagtcggagggagagcatgatgatatttataggggttagccgataacgccccatccggaataagacccacaaagcgatataagaaagagtatgctgtatatttcatatttccgtatacaggttgaaaagccgacaatgacgtagtatctatcttgataaggctatgcgagcaggccccatccgggatatgagctaggtagttcgatacaaaagtaaacgcgtttagacccaaacacagattttaaaagcccgcaacccacgtactgggacaacaatacacgcggttatagcatatccaccgatagtcctggagcccgcttttcgggaacgggctccaagtcaaaaacgtccgaacacggacgtttcaaagttggctctaatatggacgggccgtccgcgcgtctttccgtattctcatcaagagcatcgtaattaaacgtaggtccgtccagcgggagagccttcgacatatcgaccatctctttcgctaatatcgcggcagcatcgacactccaaccgccctcgcatccctctacctgcttgttaagttcatctatcaaagatgagatgtacgcatcgttagttatttccatccagtcatccagttccatttgccgtacacgatctccaaccattttcaacgcgatcatatatacggcggcatgaggcgctccgcactcctcagataaaaccgcccgggctctatccacgagcgtggtttccttcaagcccgaggaaaatccagtctgttccgatacaaagccgaccctaggacatgccatgacgaaacggtgggttctattaaaagacattatggagcagacgtttctcccacccattatgttgccccagttgccggattggaatacttttgtgctaccggccattccgtgatatttactgatgctgacggctatcacaacaaagggtttagaggccatgataggaccgacgagattagtagatgaaaaggcagcacaccatgcttccttatgatcacagatattttttagcagttgctgggcggctggtgccacatctgacccttgtgtgaggatatgttcgatccagggcaggaccatagccggatccctaggtcgcttggaggttgcaaccaaagccgaaatcgtgttgataaagaaatgcttatgtgaacagtacctcaggatggtattcgctagataaaattgagccagctccccgaagcatgtaggactgatgttaatgtaattcatatcggcgtagctattggtaaaccttttaatgaatgacgtgttctcctcggcatctttggagagtataccggccggcaactgattgcgttgtaagaggatccaaaaccagagagcattgggagtcgtgccattaggcatcttaacattcggaaaaagttgcgtgtgataccgtttgagcgcaaagccgagagggccattgagcacatgcatcgcttttgccggccgttgatacgcttctatcatgcccgccagccgggattttgtagcgtcggagacggtactggaaacgcctccgacgaacataactttattcttcactttaaattcccggaatatctcaaatgtaactttcactagatctccttccatgtgcaccgccagcggatcatgctgagatttgctaggatcgggaacggagatttgttgatcctctaaggtcaccgttatgtttttagatgtgatgaacccggcgttttgcaagtccagtacgcgccgcctgagtaccgcttggaactgagtcctaaaatttctagcctctacttgttgcccgtgcattatcatagagcactggcttaacgccatatcttgaacgacggcaattatcgtgcgcctggataaaaatgagagcacgggacatatgcctgacgaatacggctctattgccagcgaaagggtatgggttgcatcacctagcccttcgcgtatgttatattctctgatttctgtcaaatttcgcatcagctggccagcttcgctctcgattatattagccattgtcgatagagcacgcataaacgatttgccatcccggatgatggcatctgcgggtgtcatgtctgctgggtcctcgcatgtcagcaaaccttctttttctaacgctttcattactctttcgaccgtcagcttgtacgtgtcctgcattacactgcggctcgtctctccctccgatcgtttgagagtcgagaatggggcgtagcttcccagcgcgttcacgtcgcagtagttattcgtcatagatccaaagagccccatagccccacgcatctgatacccgaatttcggcaatcgatattctaagcgcttaattgtggtatgggcgcaataaatacgcgacgctttgtcgcacaaatcgcatggtacgtccgcgtccatggcagatgaaacaaatttcacggtatctaaatcgtgatggcaagcttgagatccgccgtcacacctctccaggtagaacaagaatcttgccagcaattgcggacaaaacccacacgccaaaattaggtaatctaacgagtattccgacgggctggccgatgtggctttggacaaatcttcgcccggaatcggcttgccgtctctatcgattaacgggtttgaggccaaatgcggcgcggctatttggaaaaaccgataaaacgaggctgcggtcgtacttgtgtcttttccgtctgcgctactcgcttctcccacctcggtcatgtatataaccgaattcgaactaaacaccattgccccgaccagtcctgccacgcgggccatatacgcagacagcgcttccactctatctgtatatccgatcggactgcaatagaggggccatttctttacatcgggtatagactcctcgtagaccgatgtcgcgattacgttttctatggacagagtagcgtcggatgccattagagaagccgtcctacgttcataccccccgccagatagctccatgccttcctttttccccgctttatactgcgatttcgaagcagattcgatgggagtgaatgcgttaaaagctgtatctgcgggtaacaatgttccctcgtgattttcgtcaaagcttaaatgggcggcacagcgcgcaatcgcgtctacattgcgaacgcgaaggcctacggccgcggtactgagcacataaccgtgtaatagacgacataaggaatcattatagaaagcctttggcataagagctccctcgcctagtgctctaggcttcgtactaaatggatcgctggcaacgcggttgaagtccgggaaaaccaagtgcaggggatataacggtattctacgaacatcgacgccattaatgctcacgactccagtaccaccgtaatgtaaatatgagttgcagaggtacacggcctctttaaataattcggtcactactaagtagagcatagtttcttgaggattcattccgagattatcgcatatttgctcgccggttgtttcgaacgacgtggctaccgggggcgaataggtgctgtagccgaatcttcctcgtgccaaatcacatgctttagtcagattcggagccttcgtgcacggttttatacattctccgccgtgaaacacaaacacgcacggatggtaatgcgtcggaacgagcttgagagtagttgatccgctacccagacccgttgtcttcgttcctgcaacagctgccacgttccacatgaaatccgcttcaactgtaagacctgaaacgagaggcaatatcgcatcctcgcagtcattgctcttggccgcgaagatcgagagatcttcagctggcatgctgctcgtgggtgcagcatatacatatcctatcggccccccggtgatcttaacgcttttccctacatccatggttaaggtgtcagcgtttatccggtagactgtacaacggaatggcaaggggcgatgtgccttccaaagctgcgaacgccggcttcgccaggagatggcactttgactttctcgtgccggatgttttaaagccagaggacctccaaaggatatgacgcaacacttcctaaagtgcgccacgaaacacgtcgcgcatattgtatgttttataagtcctcgacttcaaacttgccttctctgtaagccgatatgtcagtagatggggctagaacttttttcaacccgtacctcggtgcacgaaagaggggacgggatgaagatagtaccataccgccgctaagtagaccgcgggacggggagagataccttcggcaacatcgcaatgcgattacctatatagcgactatagacgaatttaaatatatcgcccccaaatgcttagacgcggcggaaataaagcagcggggcactcatatcggcaaattgaaacgctcgcctatactgtacaaaaacggagaggaacgtgagttcttgaatttcgaggctttgggggacgcgtggccacggagatgttttagctggaataacgtatcattcttacccacggaattcgacccgcgtttttctaggtttcatgtgtacgatatgattgaaacggtagagtttgcaaatggggcaacaggcagagataaaaaccgttttctggagctattgcggcctatgggcacgattattaccatgatgggaatgactgaatgcggcaggcgcgtggctgtgcatgtctacggcgtcaaaccatacttctatatgcgtaagatcgatgtagacaccgcctgcgggagtcgatccacccgcggactcgctgagcagatggcgagcgtggtacgctcgtctgtgaacgaaagcgcaagaaaacgattttacggctcaagcactgtgacggccgactgtttcgaagtggacgtggtacgtcgtaaggatatttatttctacgggacagattgcgaagagtattaccggattaggtgtcagagcggcaaattcgttgcgctcatatgtgataactttcacccctccataattaaatacgaaggcagtgtcgatacaattactcgaatggtgctggacaacgccggatttagtacatttggatggtattccctaaaaattgggaattgcggtgagaaagtacaagttcgagcgccccagcaccatgttacttcatgcgacatcgaaattaattgtacggtggacaatttgattggtcatccagaggacgatcactggcccgattacaagctcctatgctttgatatcgaatgcaaatccgggggagcgaacgaatgcgcatttccggtggccacgaacgaggaggatgtagtcattcagatctcgtgtctgatgtattcggttcgacaaaagcaattagaacatgcgctgttgtttgccctcggttcatgtgatcttcccgaaaccttccaagagacgtttcgtgatacctatggcgttttgcccgaagtcctcgaattcgacagtgaattcgaactgctgttggcgttcatgacttttgtcaagcagtacgccccggaattcgtaacggggtataatatagtcaatttcgattgggcgttcatagtgaataagttgaccaccgtttacggtattagattggacggatacggggttattaaccaaagagggacgttcaaagtatgggatgccggggcaaacgcatttcaaaaaaaagggaaatttaaggccaccggaataatcgctttagatatgtattgcatagccaccgagaagttgaagctgcaaagttacaagttagacgtggtggcggaagccgcgttgggggagcggaaaaaggagctgtcgtataaagaaataccaacgcactttgcggcaggtcccagccaacgtggaattataggagaatactgttttcaggattcgttgttggtagggaaattatttttcaaatacgttcctcatttggaactgtcagcgatagcaaaattagccgggatattgctatcgcgagcggtattcgatggccagcaaatacgcgtgtacacgtgcttactacggttggcgggctcgcgaaatttcattctgccgaataagccgcaggtgcgtgcgggaaccgagttcgaaaacagcatcgccagtacggatgaatttgaaggcgaaccttccccttcgaatccaaaggcatcctcatcatttcatggaaatggcggcagagtcgtcggttaccaaggagcgaaagtgttagatcccatttcgggattccacgtcgaccccgtggtagtctttgattttgccagcttgtatcctagcataattcaggcacataacctgtgtttcaccaccctaataaacgacgacagaaaactcgccgatctacgtccacgcgatgattatatggaaatcgacgtacaaggaaaatcgctgcattttgccaaaccccatattcgagaaagtttactgggtatcctattaaaggactggttggccatgagaaaagcgatccgagctaaaatccccgctagctctgatgatacagctgttcttttggataagcagcaggcagccatcaaagtggtctgcaattccgtgtacgggttttgcggtgtggcaaacgggctattaccttgcattgatgtggccgcgaccgtgaccacaattggtcgtgacatgttgcttacagtacgtgactacgttaaggttaagtggggaaccagagatgccctcctccgcgaatttcccgcgctgacgaattatatgttgggcgacgattactccgtgagcgtgatttacggtgataccgattcggtgttcattaagttcaaaggggtagcgatacagggcctcgtcgcaaatggagacgatatggcaaaacgcatatcgtccgatttatttcccaaacctatcaagttggagtgtgaaaagacattcgacaagctgttgcttataacgaaaaagaaatacatggggacgattcacggtgggaggatgttaatgaagggagtggacattgttcgaaagaataattgccgcttcattaacacatacgcaaaaaagttaagtgatttgctatttcaggacgatgcggtggcaaaagcagccgccctcgtcgcggaaaggccttcgtcattttgggcaacggctcccctaccagaaggcttgaagcccttcggggacatattggctgaggcatacggtcaaatgacggcaagcacgttgtccgacgtgggagatttcgtcatgtcggccgaactaagtcggccaccgcaggcctacgctaacaaaagaatagctcatctcaccgtgtatcacaaattggccatgcggtccgaacagttgcccatggtaaaagaccggatttcctatgtcatagctgccgcaacgccggaggtactgcgcgatgccgagcgggtagcagaagccagaggggaaaggaaattccgctttagcgaggtctctgtcccggaggttccagggacgtttagcaacagcgccaagacgcgggccgtccaaaaacccaaggtattgatctctgacatggcggaagacccgacatatctaatcgaaaacaatattcccctcaacacagattattatctatcacatctattaggaactctatgtgtaattttcaaggctttattcggcaatgacaccaaaacaacggatactgtattaaagcgatttattcccgaaacttatacagaggatcgcgcctacgcgacgcgagttgcgcgcgccgtctttgcggagatacgcagcggggccggtctaagttctagcgaggaggaagaaactcttcaaagactgaatagagctttccgtattctaacagaagttcgccgtcgatattaatgtcgcatagcttacagtacacgtcgtcggcgttgacggctgggacatcactcgaatctgtttgacgatcgtattcttttctaatgactaataaaaagttaccgcgccacacgtgagcgattatgctgtaattcttacaggccgtttttaaacaatcaatcaatttgtagtggaggtggagagctttcccggggaacacgacatacatcatgtattcaagggagcctgcttcctgatccaagtaaaacaacaccttcacatttttcattccagaatcgagtagcacatagtatgcgaaaaaaagttccgggattgccaaaatacgagaaagggcaatttcgctatctttcccccgctcctctccgcaccccattctgccgcccaaggccacgatagaagccatgaaattcctataatgataaatgttgtttatctgttggacatatgccaatatcaaagaggcacgatcgtttcgccccaatcgcgggtctccgctagccgtgcacgtagggcaacagccaccaactccgagataataccccattcccgacaaagacaaacagttatctgcgacagcttccgacatattgaacggcaacgagactggcgttgtcttgatgatcggcacagccaaatccttgactaccattagttcctccgatggggactcttcaacgaaatcgaagtaagcgcgatacaaatcgacatctggttttcgagacccgcgtttcgtaccgcatgccggcgcttgtagatctcgccattgccgccgcgaccgtcttgctatccctccgctacgccctacagatctgcgtcgtatgaaaatgcaaccggtcatgccgggaattacgatgtcacacgtaggtttgtagcgtgtgctcgagagatatcagggatatagagtgtctttgaagaaatgcgccagcgtctttgacgaacgcggataaagtagtcggccggggagggaaaacctgatatgtcttgaacgtgtacgccaaggcccaaaacccggcgcatacgcgaccttcgaaacggttatggcttgcgagccgagctttatggagtgccaattcttcccggctcgctaggtccgggtggtcgaacaatgaccgtggattggtctgcgctatccgcgcagcacacatcgggtcgcaaaagaagtgtttgtagattgcttccgttcccgtgcctttgagcagcgccacgaagtatccgtcatcttcaaaatcggcatttctctcctgcgtcccccacgcctccaacaccggttctatgctatggaaaatgccgatgttgttagctgaataggcaatgatatcgcgcttaaattgccgcattgcaagccagtacgtgcggattagtaggaagttgcacaataagcattccgcggacgttccccctttggttatcgcgtgctttaattgtgttaccattaagggtcctaactccaaatcaggttctgagtcatcttcgtaacagtgactatatgcccgagtcgcccctctagcaagatctattctgttgtctttccaaaacttgctgaccgtctccttcctaaatttcgctgccataagagcgagttcgctcgccccatctggtgcagatcccgtgcccgaaagcaataataggacgagattcgtataacccatagtagagtcctcgccgctcgaccgttccgtatactgagaccgattagtgcacggtgctagtgcaccaagatcgttctccccgtcaggcagtgctttgctcaaacgaagctgcaattcgcgctcgtaaatatcgtcgtccgacaatgcgcgtataatgcaactttccgtttgagaaaaattacattctacgcttctcgcgcagtccttccagcctgccaaagcgacggaaagcgaggtgggaattgagccgaccgtttgacccgtttgtgggactttccttttactttcgtgtccagctgccgtgtcgcattggccctcgtacgacgagtgacccatgtcggacaccgtcgtcaacatggcccgcgtagcgctttgggccaaatacgaatagttactgtacaacactttagcgtcacccgcgcacagcgaccgtcctcttttccccgccgaacggccttgatttgcacggggcacgataacctcgttatgccgtcttcccggtacccccccgtcagttcgaaaacaaccatgcagaaagaagtgtctctggatatcctcaaaagttaaatgctttctcccaaacgagcctaccaacgtgcaaccgtgatcgaccagaaaatgcttatccattatatacacgaattcgaacgctgctataaacattgttgtagcgcatggtggagaaccaagacatttggaacacaaaaatgcgtaatcggccatccatatagccgataatccgaatttgtgcttatatatatctaaaacacggcaaacgagacattgtctatctagagcaaaaacctcggctgccgtcccgataaacgtcgccagctcttgatgctcgattccgtcttcgcaatcttctgcgctttcgctaccactgcaactctgaccagcctgaagactgttggtcttaatagcgtgggcggagagtagcaattcgttaaagagcgtatcgttgtacgtcaatatttcaggatcgaacgctatgtaagggcattttaaggactcctcgacccatccttccgacgcggatgctcccggagatcgaataaacggtagttcgacagtacgatgggccatggccgctgagacaaacactcggcaagtagatacgcctcggttagccgacgcgatcccagacgtagagttgctgtcggacgatgtcgataaattagctgaacgctatatttgcgacgggatcgtatatcgcgtatggttcgaatacctaatacccgatgaattagatttgattttcccgacaaccgacgggaagtttaattatctatcattcactagaagacttgcttctgccatccgacatggtcgtgccggagctgggagtgcgacccctacgtcgtttatcagtgccgagcgtgtctgtgaccatggggccgttttgagagggcggagcgagagatttgcatccgtaattaataggttccttgacttgcatcaaattctgaaggattgttagaaactagcaagccgaacataattgctccgccgtatatctttttttcttttacgaaggcatacagcgaatgatgagcgcgcctcagagtaagccctgtcgtcgtgcaggactaatagcacggatcaggctcatcgtcggcggagatttaactatgggcaattccgatcccggactcgcggagtctttttccggtcgcgttccggcacgttgcgtatttcaattcagtggggcagacggcgtggagagcgcgtttcccgttgaatacgtaatgagaatgatgaacgattgggcggggggtgagtgcgatccctacattaaaatacagaataccggcgtctccgttctaatcgaagggtttttcgctcctccgacaaacgccgctagagcgccgctgtgcgccgacaaagtgaacgtcctgttaaacactaccgattctacgggcgtcgttttatctgatatcaaaaggtttaaaaaatcagtgggtgtggattgcaggcctttccaggcttgcctaaacgttcattgctttgtaaggctaccaaatgttcagctggccttcagattcgtcggcccgaccgatccggccagaacatcaaaactgctcgactcggccgtagcgtcttacaattcgaaagcgaaacagcggttcaaaaacagttcgagggctatcgataacgaatcgagaccctgcgcacttcatgagtgtgttccgatcccggtaagagatgaaacgcagaaactgactagccaatctgatataaggacccctaggcgcgtgctgaccatactcaagaaaatttcgagcggtgagtacgtaacgaccgtacgcgtctcgatccgcaaaattatactgtgcctggtcagtgtattcgtagttataaccgcctggtggtgctacccgctctaaaacctcgcgacgcggcgtcacgtttccagtcggaacaccgcaccacagagtcatcatcggcgccactacatcgcgcgagactgcaatgtctcgcacgccctctccccagctttcgcctgtttcacaagcgttcgatccctccgacttgagcacttacaagttggatgtgctggttaactaccccctctcggatttggtgcatcaccttaatgccataccgcgaaacctgcaagtttccgacaggcattccgacctgaacgcagctaaaatcaacgttttacgggctctttgtgtgggattttctgacgtgcggcgcaaaaatgatactcgcactttacaacgcacgcccatgttcgcaatcggcgacgccgcatcgcgcttgagaccgtccattggattgaaacggacattccccacgggcatattctcaacaactatcataaactctcccgcagacgatgatgcatagcttttgtgagtcgacatgctttaataaaaaattatccaaatcgaacgagtctacttccctatgtcagttatccggtcaggagcattttgattttaaatatctctatcgttaatgtatcgattctggctctcaattgttgtcgtgcgtgtgcgatttgcctggccatcttttcgcatgccctagtgagtgcgtaaagcgcgctgcgtcccacctgcctaaaatcgcgccttgtcaataatctatcggcagagattactcgggacgcgctcgattcgtccgtgctggagcgatcgctatcaggaacactagattgcgactcgccatccgtgttagaatccacggacgatagagactccagcgcaaacagatatcgctctgggtcgatattggagtcctgttgcttattttgccctgcttctgcttccgtgaccacgaaccctctgtacatgttgtgatggtcgtgctttgccgttgtcgccttgcatggcgaacgtcggcacgtattaatgggtttcgactgcgaactagacggctgcgcgggtctcgacagaatgtttcccagaaccgcactactcggcgacgaaggctccgctaatataacgtccgggggcgcaaatgcgaagtggtcgtacagtccgtgctgcgccggactcccgaccgccgcctgctttttgccaccaggtgccgtcgagatatcgacggagcggtcaaccggttccaggttaagatccgcggtaataacggctggcgacgctcgttgtaacaagggagacgagtcgcggcgcacggaagcgagtccccctaaagtatcgcatcttggccttgacgcattgttaggacgaacacgggcggcgcccttgtccgagatccgtccgattgaatcaatcctcgttccggcacgcgacggcttcagcgctcttatccctattcctccgtcttcgtcgtcgggaatcagggattttgtcgaagacgcgacaacaaatggtgttgaggtcgaatcggagtcagatcgatgtggaatgtttggagttccatgctttttcctatcatcgcgtaccgagttatccgaaataactacggcaggggacttttggtcgagagcgcagccgggtgcgttacacgcggctgccgtatcggtaaattttagcctcccacgatagacaggctttggcatatcgtgcgcccgttcgctgacatcgatatgttttacggggcgccccttctgcctctcctcgatcccgactgctgcgtaggtagattgctcgttatgtgtttttttagttacgacgagtttttgagtggctggagataacagggacgggctcaatgtttcattatttgggggggcgagcttatagtgaaaggcgagtttggaagaggcgccatcggaagcatcggtgctaaccgtagaaggacactcgacattctcgggaactacccggtcgctacgatcgttcaactctttatgaaacaaaaaacccgtttcagcattgtcgtagacgtccttctctgcagccatcccatcccacatgctctctctatcccgactaaagtcattccctggtaattcttcatcttccgacgccgttccaatagatagtacatcctcgacatcgccgtctcggctcttgttgtacacggggatcggatattgtctagattcgtcggaaaaaaaattagccgcgtcctgtcggtcgagcacggcgatgtcatcatatgacgcgcccgtttccacgcgaatgcccgcatctatgtatggcagttccgagagaacagcgtcatcgctggaagttagccgtattacggggatagggtcgaataccgtcttaggccatagaactttcacgggaaccattcccgtgtccactatcactaaacacggaggagcggaagaaaggggcttggaggctatgagatgggacaagtgttccagctgttggccgaggcatgcattttcgattggattgctgtcgtctgccaacaatttccccccccaggaagtcgtgtcggatgaaacggcggcaggttcgagaaagcagccctcggagccgcttctcgagtcgaaaagacggacacacagattcagtccagagccggaggaatacgcttctggacattctgcggcgatcacgatccgtgccccgaataatgtagctgcggctgccagatccatagcgtttacttttaagactccgctagggggtgtggacgtgacggtaaatgtcatcgccactcctgtgggttcatataaattgggaccgtctgaacctttcgggatagttttgtcggcgggacgtaacacggacgatgtggtcacgtctaaagtcgaagcagcgtccccgcgggctgtgacgacgtcatcgtagcttctacagctttgctctatctccgcgggtagaagcgaggaccacatcaccgccaatgcggttggcggaatgcacatacgagccagcactgttgtcgttgtcaaaagattcgacggcacgaccgcacgaattttggcaaggcccgtactcgtagccccacctacaccttcccagggtttaagggggtctgtttcggaaaggctgccttgtttccaatcagaataccgcaaagcaaaaagggatccgcctgacgggtcccacgctccgcccgttaaactcatcggtcggcaattcgagtccgacggggcatctttggatagctgcgtagataaacagttgataaacgccgtagtggacagcgactcattgatagcgccatagagcgtcttatccataaaatcgtactggctaataagatcgagctgggaaaaggtcaagacgtgccccggcatgcacgtcataatagcaaccatcacgtcggccaactccagccgaacgggtcgtccatttgcagctatttttttaagcccctttttgtcggcggcaggggcgacttgccccggaagaaaaaaaatatcagacaagctagcacccgttttacgcgtgagcgtaatggccattaatgcgcaataaatggacccgatcgcttttactgtgccatccgccagccaatcgtagttttgcgtacgtacatacttggtgaaggcgcggaaattatccgccgcggcttgaacgaaacccagcctcaaggccatgatgtcgcctagcatgcccgcggcaactaccatatctctagttgacataacttttgaagggatcgcgggcctcaggcttaggccggagggctcgcacaaacacgcggccattttttcaccaacagttcgatagcagacagaatatctcaggggcgcgtcggaggcgtctaaatatgtatggatgcctgggatatctatttcagaaaacgcctcctgcagcgtgacaacaactgatggtctgatccaagcagctactcggtgtttaagatatcgatccacgaaccccgcggccggtctgttgttcgcgtcagcattcaatcctgtatcagaggggaggagcgatggacacccggcaactcccggcaaaatggcggaatatgcagcatacagcgccaatctcagctttacaagccgcgagtatcgagttacgtgccgaacgtaccacttggggagccgtttagagagaatatcgaattgcgaggctattgtactgagatcgtttaagacaaaggttggcgggatctttgcacacagagtgtccatctgtttttgaatcgattccgtttctttgagggccgccagaaaagcatccatgactccggctctgtctctgtatttcgcatcgataagtccgatgattttagccggcagcctagcatactctgcgttatcgcgcaaagcgttgatcgtattggaagagactttagcgcgagcagcactatctcgggcggcggcaaacccctctgagctcttgtccatcctgtccttatcgtgcataaacgtggaccatgtgtcatcccaagcgacttcggcaagcgctagttcggattttaactcgtccaatcggctcgctaagtccgcgagagcatcgatccgctccgcgtatatagtcatcggaccgctttcgtcgatccgggaagttagctcgtgcgaatctatgacagatcgggcgtgttttagccactctaccgtttgggtatccaattctttagtttcttcgactttactcaaaagtattgccgcttgagtgactatgtcgttcgcagtttcagccttttcaatagctttcgctatatgcggaggcatcgcgaccagccgcagcaggttttttaaattggccaattgctccgccgtctctctgtctgcggcataagaaacttcggccaaactcttcagaataacttcagctctcgatttcgcgccctcaatagctgtcgttacccgcagctttattgaggagacggcttctatatcgcgttggagagtatgagcgctatactctgcataggctgtcccgttgaacgccgtaatgtcttccttttccaaatcgttggttattgtcagtatggcgttcgccgaaggaatcacgatagagaccccatattcaagagcgcgacgcgccccctcagggctatacattctagccagattctccaatgcctctctaatttctatatctaccctccccgctgcgtgaagagcctctaccctcatttgttcatgccgagctaaaaagcccgtaaattcctcatgcccgttacgataaaaatccacgtatttggccaacgttgggaccgctcttacgtctggttcaatttcgcccaataacgtgtaatagtccaagttcccgccgcgggcatccgcgtgccttaatatagcgagtactatcttgattaactgtagcaaggcgtcgcagctaactccgaaaagttttgtgtaataaggagccgccgctataaacgcgtctagccaggtcatatttttcaaaaatgctataggaggcagaattccatgaattctattcggggtggaaaacgggttgaacttcaatacagtttctatcgcatcgtgaatcgcacgaccatgcgacataacaattttctcggctctggctctgaaacggatagtgtcgtagccggccaccacggcccttttctccaaatcactcatctccatagcatcaaattcggatttcagctcggcattggatagtagggaatgaatcgaggaaacccaaacgtcttcgctatgcgatctctgggcacttatcagatttctctcgtaggttgtaacggccgcctccaattctacggtccgctgatttacaagccctaccgattttgccaggtcggcaattttacgttggatgtgggggtccgtaacatgcgcgtgactctcgagagctgcgatggctgtattggcgtctctcgcgctctgcagcgcgtgagctatttcagttctggcgctcattataacactggcgtcgctatcagcggctgctgttttgggatctgaagttttgaccttggttattgacgcgatcacgctattgagtgccgcgcgcactgcccgatgtagaccatctaaacggtccccgtgctgcgccacgcccgcggccacctcagcgtcggataacagcaccgttaagaacgaaaacgcgtcatcctggcctgcgggtagatcggccattattcccgtagagggagtgtctgcagtcgccctgtttacatcggatacggcgttctgcagcgccgtaacagccgccgtagttttttcgaccgacatcggttcgaggcgcgcagcggcgactgctgcagaaagcgtatcggcatgtttcccgaaaaaaaccgacgcggccggataacccccaattggacccaatattacgcgtatggccagagagaaaggaatgccgaggccagataactctgcggcagtgctcgtactggggtgtgacaaaattgtcctatactgagagaacaacagccacaaatccgttcgcaaagtcccaataacatcgggtggtgcgagagctagaaaggtctctagcggccccgtatctccagggatggattgcgttatggttttgactgtcgagtccaatgcgcgcaacccagcaaacctttgtagaggacgcagcatcagcttaatcgaagaatataaagttctgatctcctcgtaacgatattgaagtgccgcaattaaggtttcggcatccagccgcctacgggcgatagccgcgcggtcatccgaacttagcaaatttgcaaatttgtcgccccctaaagcatttgacaattttactaactcaaccacatccttcataacttcctccagtttttgaagatcggccgttgtctccaaatcagtgtatgacgcaactctagcttccaactcatgtaagcggtccaaatccgccagggctgtttcacggcgggcggcgttgttgttaacggcatcgacttctttgatcagtgtttcaaactcttgtcgactaatccacccgcccgcttgaacggctgccattgccgttttccataccgccagattttctggattttctaaattagagtcattttccagcagatccccgagcaatttagattccggtgcagttgttacgggcggcggggcctgcgcgccactacgcgccgctactagggcaataacatcatcgagcacagataatgatgcgaacagcctggccattttttcatgttgctcgacaacgaccattttaaatctagatgtgctagccacgttggctcgaagcgcattcgcgctatagagagcccccttcaagtaatattcgtgtagtgcgttgccgactgcatcaacggctgccctctcaatagcagtcaagcgctgtgtaacgacagatggggagactttagctatgctctcgtcgtcgcgcgatccagaagtacccccagatcctcccattataaatgcatcaaatgaggcgtgcatcaatcgaacgccggcgtcgagggcctccaattcagctagtatgagttccgccttcctcctggcaacagtttccctatcacgtatgaacctgcacagcgatgcgactctgtcggtcaagctctgttcggcatgcaaagacgtcttctctgagtatatctttcctggattactattaaacgcgcttactaacgatgtcgccatcctttcgtagattctatctgcatccgcagtgctcgcctctctctctatagagtccaaagttttgtgaagggcatctgtgagctcctccacttccagagccactaataccagcttgcttagggccaatttgcctatcttggaattttcagaaagtacagattctatgaggtctgcagattctccggctcgcgaaaccgccattcccgtagaatcaatgaacgcgctaaagtgggcgggcctcgtaaatgctttaaataatgatgccatctcggcttctacgacagatcctatttccgttgtggttcgagcgccgttttcgataacgtagttgaacaatctggtaaaagtatccagcccacatatatccagaagtccgtcatagtcacccgaccgtgacaagtggatggtcattcccatacttaaagctatagattgctctaaatcatcgatgttagcattgatgtcgctcagaatagagctagggacgtgttcgcttgtccatagcccgtctcgtagcgactcgtccccttcccccgctaccgtgtgaggattaaaaggtggccggtctcgcaacgattggccgtgcacgaagtgctcagcacgcgcctgagaacttataaactcattgaaggagacattgtccggccgggtagcttcttcttgaccaggtatattatgtgtcgtgctcgatccactatctgcttgttcagacaaacttatcgatggagccaccggattgtccgtataggtcaaacatcgtttagttttccgggacggttttctgctcgaagattgaccttggccatcgacggataagttctctgaacttgacggaggagtccatacagggcgcctcctcttatgtctctcaaaagactgtttgggcggggagctagatttcgtgtcagtttcaagccgaactacattttcccgcgttttgggcaaatcaggccttgttagcaccgacagatcatcgccgatgtccgggaatgcagtggtccacgcatttacgatggactcatgattggttatatcacatatggcatcaactggagcctcctcgggaggcaggacgtatgcgtcctcctccgcatagcccatttcccgcctaacatccacatcccctgcagcgacgggagaacgatcacttctggaatcgacagcgactttgatgtcctcgctacgtgacgtggaggttccaatgatgatcctagttgttgtaggctgtggcctgtaagggggatcgagattggccagcactactttaatgttctcttcctcgttaaccctgcctagatccaaaacgatgtccgctgtaccgtacagccgtgatacggctgatattatttcttcctttggcggtgtactggagatcatagatacaaagtaaacaaaggtcgcggaccactctggcgccgtcgagggatccgcataggacgtgagatattgataaaaataaccctcgcttactcgaacgatacacgcttggcctatgtggccatgaccgtgtggatcgaaaatgtagattccgttatcggatctgtacacccctattcctatgacgccgatgacgatcaggcaataaatatcacctcgtttctgcttccatactttttctatgaatgtccgcgcagatatttgggtttctaagatagtggaggtgttttcatctacgtagaagtccaattctccataggagctcgaaaacgcaacacacaagttgccgtcgggctcatttgataagatcctgtttggtaaatcgtgagggacgcaagtcgtataccttccatcgcgagaggtttctattgtccattcctttccctgcaataacagtctatctatggcctcggtcgacaataccgcatccaacccatacgcaaaaactacgcgcagaaacgccaatgacgaccgcaagcatgaaaccgatgaccccggactcaagtccggggcaaattgattcctgttgccaacggcaactagtgtaaagtcggtggcatcaaccaccattcttgcccattcatctaggattacctccgaatccatgtttgttcccgaacgcatggcgcggttttgcatgttcgagacggagctgtccctcgaattatccgatgtttccaagcgccgcgtcgagggactcggttgtaaccgcgtagatttcttggatgggcgtgtagtgctccctctactctcactagcagccatatagacgatggggcggaatggcgcgtcttttcagattgcgctttgtcattgagcgagttagacattaaaagttgattaactccaaaattgtgatcaatcagttgcggccgcgtaagtggcgtggctgcaacatccaagtcggcacgaacgaacgatacgccaggccgtaaaacgatagacgtgtgcgtcacgcattgcgatctctcgcctgcctttcgttattaaacaccgtatcgacaatgtcgaccaaaccgtctacagttactctcggttttatgaggaagtccttcgcaaaattggcaaggtccacatcatcgtgtgccaccgtatccaaatccaatgtatcaaaattgagttcgtcacgatgagttaaattgtgcctcgatgtcagttcgactactagggcggggctatcgtcggttactacgggcagacggcccagcagggtcgctacagctgcgtcgatttcgtcgttcgtgacacggtcttccatatcacgcggaacctcgatccgatcagctattttttgccatactactcccacattctctatagcactggccaagtcctgcgaacttctgtcacgaaacgtagaatttatttccgacaacgtttgccatttgtccagcagccacacgatatcgccggtcccgggcggcgtggaacacgatgtcaaggctctgacgtgcaggtccagcgaattctgcaggcgagccaatctggcatagtcggttccgagggtagaaaaatagcttgctgcctttacgctaaataaaattgcgcgctccattaaattatcgcatgtatgaacttgtttcccagtttcttctattaaagtccgcaacaccattgatttgagtcttacattcgccattacatcacccgaggagtcgtagaattccctgagagccgacagcacatcaacgattttccatgtgccaaaattggcacgcggctcgccacggcggtaaaccgttacagtacctcctgctgtaccagctgcgaatttacacgcaaagaaatgcttaaatatgtacgcaaatttaaccaactgcctggatcgctccgctaaatatgccgcacacttcaacgttctatccgctaagtaattgaattgaagtcctagggccgttccatgcatactaatcaaaagcaaactattcgatatctctggacgggggggcataatcggtctggtctctggcggtaccatctgcacggccgcatagaccacgtcgtacaattcgcccatcagcatttccagattatacgcatcgtccgtggtaggcttggccgtcagatctctagcaaacggagcgagtgaggaaattagagcattgagcttgtttctatgattcacgaaactgccaatgtacggcgcgccgtaatccctggcccaagtcaaaatttcgataacagtgtttatcgggcgttcagaaaagacagatgtcgtgatagccgacaatgcgtccacgcaaacggtagctagaatatatcttagaaaatggggagttgtgctttcaggtgtgatgggcatggattcaggatagcgaattgtcatggccagacgaatcatacggctctccaggtctgggtccactgcatttggtccagagatactctctaaatccgaatggtccacactagctagatgttccgacggttcacctccaattaactcttccggtggcacgattccccatatatgctcggctctggagtcgaaccatagcatgagtgactcctttgcaaattgtattgctcgattggcagtcccggccccgctctggcggattgcgctatccatttccgcggcgaggatcgctcgtgcagactttacatagtcctcgtggggatttggcggtatacatcgccctaatatctgagctatgattgcgctatctaacccaagtacttttatgaaatctgaatcggcgtccggaggaaggccattgtccatataattggttaagtaagtcatgccgggaccataactttccatgagtccgaaaacgatgtttccgatgacagctatgcatccgataacctgttgtacgtcgtcaaatgtgtcgagttcattaacagtaccacgagtttttcccaaatttgcctttagcgccgattcataaacccggcatgcctgtctcacaaaacctctttctataagcgcttccaataactgtctcggcgacgaactgtgttgtacagccccccatgcccgcctagccgattcggagagtttcgctttagcagcatcgagagcgcccccgccgtcatttaagtcgccatcggtaataagccggaccacggcagacatatggatcgctaaggcatcttctgttaatgcgtgatcagctaatataatgtctggtccgttccgcaacttttccgctaccatacccggctgaactgcatatacatacgggtctccgtatgctatggcggcagatgctctaacatcatatgctgttcttttcatattgtttgcctctacggccgagataagttcgcgcgagcccaatgcgctggcatcttctgcgaatagatcctttaactgagaaggatggggcgatcgcggacttttaaaatattgatcgacaagggccagcgtaaatagtattcgagtgagtggcgtaaaggccctatttgttgtacatcgagacataataacaaacggggtgatccacccgacggctatagaaattaatcgaattccttcctgaacaaacgggaaatcgtaaataagtttaaagcgcgtctgcgtcaaggaagctggtagttccaaagcattaggagcaggttgacgtccggataacaacccttcggaagtataatcaaacgcgtccgtggcgatctcttcaaaaattgtcagccactcacttattaggggccacaaaacactcggtccaaaaggacatgatctgcgcagaccgtttcgggtaagccacgcaatggcttcttctcccgtcatttcggccgccaatctacgcaacctacgagaatcgtctttccaggacattttatcccaccttacggaggtacgccacaagatgaatccgacaaaattttgggccagcattgccgcttctgggcttcctgtttgtttgtagacctcgagcacagccgcgaatgcatcgcgccacgtcgattccacttgctgaatactcattgtttctagagcctggaaaaatgatccgatagcagttcttgcttccgcagctgtagcatttccccacggttccagtggcgccgttccagccgataaagaccttagtgtatccagtaaagttttcaacgggaatctcgcttcgccctgggtttcagacatggcgcgccaataggtagggatggatctacgtatgtcaatggaggccgtataaagcttcaataataatacgttccctaaaatgctgtgctccgcaccgcagaaaaatatcgtgtgatccgcagttacaccataccgtactttatcatctccatgacgcatcgagatcccgtataggccggcccacgtaagaggcacacgcgctacataactttgttgcgtttaactacaccgccagtcctgtattgcagtatactaggtgacatacagcgatttttatgtgcagtagtgcacacgcagttgtcgcaaaacgggcttgcaaacgatcatcgccaatacaggatctctttataactggttgttgatagtggacgtcatgaaaaccacttttcgaacaagcgacgtgcaggcatccaacacgcagtcaaatgcctcggacaggctgcatgacatcttacggagcatcaataactcaatgcactccggcattgttcggcgcatcaacataggctatccgcatgcgggcaacaggcgcgggacgttgaccgccggattggaactgttgagcaatacgatcacaacgacccctcccggggcaaacatacaccgctccattgcaaattcggcaggcgaagctacggcaacgatcatacaatctttacgaacatattccggaagtggagatctgaacacgaatggtgataataacgtcctttcccgacagatcagcctgacagatttctgtttccccgatgcggagatgccaggactaattgtcttatctatgcgacatccactggatataaacagcgaagcattatacagcacacctgccggacgggacccacgggcattggagtcagcgtggtatgaattatctgaactggccgcggtatcggtaaacagattagacggaagtggtgtccggccgtccctattatcgctctcatttcttattgcttcccgcgcgggagactatgcggataaatgtggtgctgaggctgtaagagctcacgtgattagcaattacggccgccggcggatagaggacaggctcgacaggttcggaagctgccaagcagcaatgttgagatgtcacgtgttcccacaccgacatatgcaagtattagggggaatggtgtcgtggatcgcacagcgcgaaatcgccagtataaccgccgtggtcaagggctctcaagagagcgccaggacagaacagaccaacaatccaagatcgtcggtatacgttcccgcatgcgcctatctcgatttagataaagagattcacatgctccatgatgacagagcttcttcgctactatacctcgttttcgtttatgcacaacacctcggacgcgagagcatccgtgtatatctcatgcggagtcgtttaggggaatcggtgttcagagaaggcctcggttacctgtactccgggctaagagccggtaacgctattaacggtctggccggtataatagcgccacatggagtagacgcgaatacggaatttccattatcaaaagctttcgaggtacacaaacacgcctgtcgaaacaccggaatcggacctcgagactccgagaaagtggactggcgtttagatctccgaggccgccctacaaagaattcctgcatgtacgcagcatactgtcgcgtagggcacttgaacgagtattcgatgccggcgaagaagtctgaacgttgtggcgggtctgtggaggtccctgttgtatgggtgccgggagtagtgtgggatatcggagaatggaccgagtgttatcagtagagagttggctacaccgagatccggcatcataccttacgtgaactgcttacgtttggggatgtttttgcgtcggtgtttggggaggagtcaatcttataaaaagcctatttgtggtacgcttcggtctcgcgctcactgagcaacccgtattttatccagtctgaaatcagaatctaaaatgcagcgatccgatgaaaacgaatccctcgaagcgaatagaaatttggacaccgcctcgcgtaactgtactgatgtgcaggtagccttgataatggcaacgaaattgcatcgcatccagcagcaacttgcgagcatgggatatttatctggctacgattccgtgcccgatattactacacccgtgaaagttctgcgcgagcgcattacccatctagtaaatacattgaaacccgtttgccgtttcgatgagcgcgtgtactacgcctgcggggagctggtgcatttacggatcaaatcacaggaagctacttttgatgcgtggttgatgtcgaaaaaattaagcctgaaaggcgagatcgtagataacatacagcgccacagaggtcacgtagagacggatatgctgcgcttttacggagtaacctatccctggctgaaacgactgggtttacagtcggcgttgaaatacgaagaatatctgactgagttggaagacggcaaaaaagaatctctttgccagttttttgttcggctggccgcggcggcagcaaccgaagcgtcaaacaaaaaagctttcatgtcggctttgggtaccgaagtgtcgacctgggaaacggctttcacggctttttttttcgctctcgctcgtcagatatttgtcccatcgactccctgtatgctttttttggggcgcgaaggaacctcaaccgcgagctgttatctcatggaccccagaactataaatacacacgatacccttaaagcgatcgccgacgatatagttccccatctcctagcgagaggagggatagggatatcgttgcagcatttaaaccaaaaaacaggccttatgcctgtgatgaaagtattggattccttagtgatggccgcgaatgcgggggagcgtcgacccacgggggtatgcgtttatctcgaaccgtggcacgcggacatcatgtctgcattaaatatgcgcggcatgatggcgacggaagagtcccgtaggtgcgataacgtatttatcgccctttggacttgcgatttactgtttaagcgctacgagagacacgcaaacggggagaaaaatgtgacgtggaccttattcgattcccgcgcgtcgatattggccacgcttcacggatcggaattcgaaaaggagtataaccgtttagaagcggaaggtttaggcgtagctagcctccctgtaagggatttgatgttcgcaataatcaaaagtgcggcgtccaccggtagcccctttattctctttaaagacgcgtgcaacaagcactacattacagatactcaaggagacgccattgcaggctctaatctgtgtaccgaaatcattcaaaaaaccgacggaaatacaaacggggtgtgcagcttagtaagcgtcaacctcgcccgatgtgttttcgacgagaacggagagaaaaaatttgatttttccgcccttagacgcgccgtgcggctggctacggtgttcgttaactcgataatgtctagcagcgatgttccgactgcgaaatctcgttccggtaaagatcgacacagatccatgggcataggcgttcaggggcttcatacagctctgttgtcaatgggtctcgatttgagcgatgaacgcgtcaagcccctcaacaagcagatttttgaattgatgttgttagaggccatgacggtcagttgtgaattttgcgaaggcgggttgcccgccttcgccgacttctccaacagctattactcacgggggcgcctgcattttgatggctgggcaaacgtaggcttaagtatgcccgaagagtggaatgcgctgcgggagagaatacaggcgtccgggttatacaatgcccagttcgtagcgttgatgccgacagccgcatccgcacaagtaaccgaagtgagtgagagttttttgcccgtgttcagcaacatgtttaacaaagtgacgacggcgggggaactactgcggcccaataatcaattaatgggagagttgagggagatctatgcggataatgaggatcggcgattgaaagccatagcagcgttggagtgcgcgaactggtgcgtggagaccgctctgggaaataagcccgaatgctctcaattacttaaatacaaaacggcgttcgagtacgaccaatccctcctaatagatttgtgtgccgatagggcgccttttgtggatcaaagccagtcgatgactctgtttgtgacggaagcggctgacggaacgctgctggcgtctcacgtcatgaacctactcttacgcgcctataaagccggcctgaaaacaggaatgtattactgcaagatacgcaaggcgactaatgccggagtattcagcggtaacggcgaattgacctgctcgtcctgcatactataatctccaagcatcccggcattttgaccatggccacgcaagcacgcgggaacgaatttgtcagcggccaaaccgcacctctgcacaaaaacccgtgtcccgaaaacgcggcggccgtcctaaagatggaaggtatcgagatcgaaccttcgactagttccgctagagataattacaaagtgtcacggtacttctacgtccccgaatgcccagatatagggcacctccgagctttgagtattatgaaccgatggacggagaccgaatttgtcgtcgccgaggatctcggggacgtcgccaagcttagcgaagaagaaaaaaatttctaccgattcctctttacgtttctctctgctgcagacgatttggttaaccttaatatagacaatctgttaggtttattcgaacaaaaggatattcaccactattacttcgagcaggaatgtatagaagctgtccactctcgggcctatagcattattcagctgatgttattcgacaacgactcctcggcgcgcgcaaaatatgttcagtctgcgttagagtcccccgtcatccaatctaaattggaatggttagaccgacgtatactagagtgcacgtctataccagaaaaatatatccttatgattttaacagaaggcattttcttttcagcatccttcgcggctatcgcttatttgcgcacgaataacctctttgtcgttacatgccagattaacaacctgatcagcagagacgaagcgatacacgtagaggcgtcgtgctgcattttcaagaattatatcgctggcaacaagccatccaccgctcgcatccaagccttatttagcgaagccgtcgacttggaatgtgcatttctccgcgcagccgcaccacgcgactctcgcttattggatattggctcaatctgtagctatgttcgttacagcgccgacagattattgagaatgttggacgtgccaccgatttacggcgaacccagccccgctgccgactttccgctatctctaatgtccgcttcaaataatacaaatttcttcgaaagaagaagcaccgcgtactccgggagtgtatcgaacgatctttaattagcctgtgtgcaactgtactttctacccctacccacaagaattaataaatgaattcaaattatcgcttttcgcaccgtgtagtttgtgatgcatcccttccccagtaccttatcagcacggagtcgaaaggccgtacctccgggatacaccttagaaatgcggttgaaataactgaagcttcggcctcattgggtatactgcgaaacaccaattcttcaaccgctacatcgtcacgtatatcctgcattatggggaatcgttttaaaatactaattctgggcgttctgcgctcgggcattatagtcgcaatgacgtgctttatgaacttgtattcgagaacttcgcatctcgtttttggggggtgcaaagatcttaacaagctgtaattggacgcgagatccctgttcgcatcgggcatatcagccggtctctcgtaatgatggccgcccgtgatctcaggattgcaacaattcatcaacgacgaccggccacgctcgttatcgctcgctttaccgcagatagtgcccgaaccctgcttcaatgtccctagatctattatctcttgcatggatttcagtgtgtgttcgcaatggaggtctgtttgacaccgaacgaagttagacaaaaacgtgaaatagtccatttttaacgccgccaaaacatctctgcagtagatagtcggcggaaatattctagtaaggtcgatgattatatcacatcccatcaatagcatgtctgtatctgaagataacacatacgcaaccgttttggtgtgaaagaggttagcacagatatcgtccgcttccatcatggccacatcgacataagggtatcccatatagcgaatggtatccatgcagagcctatgtagaattttgggcgtatcagacttatcgctccatctgcgtggtcttttccgcttccgcgttcttttgttccgcgcttctccggtatccgcattctcgcattcgtcgcgcgaacgtacttgcagcctcccagaacctcctcccctcgcgatgcgagtagctgctagcgcctttgctccataaagcgttttcccatacttcgaaaacccccggtccgatacaaacaccggataatacgaccgttggtgtaacaaacgcagcagacagtataagcaccgcagcgtggcgaccgagttgtcgactccgtcgaccttaccagggtaaattttttccagcagtccatacataacattccataaatccacggcaatgggcgtcatagccccgccggatatcgaacccgaaatgtgacttctcactaatccgttcgcataggcgaagtgcatgcaaccgtacacgcccatggcaactttcggagtcgcagtgtaagagacacggggtaatacgaattttgaattttgggagtatctgtcaagtatattcaactcttgaataaccacgaccaggcgtagctatccaaatgccgaaacgttaagccgctccataaaaccttgattccactattcaattgtgcaatagttggattagggcaggtattcggctctatctgttcaccgtatacacgctataccgtcctttaaattagacaaggtgcgcgtctctaaacctataattcccggtagcggtataagcgacacttattacatgcctatccaccacgtgatgcaacccacacgattcacgttgaagacatgtgacatttgctgtaaatatacgcaggtaacaatgtgtgcggcgaattagacttacagccaatagtaagcgcgacataacactaaatgggcggcgcgacattcgagtgcctataggagaccgatatacgtaaccacgcgtggtgcgattgcgacccaggctccttcgatataagctttccccctcacatccggagccatccgttagattgactctgcctcagcctatacaacgcgccaaagaacagtgtgctacggacagaagtgacgccgacttgagttcacggcatcgagaccccagaaccggtctcggcgatggcgcgaataactatgagcgatgaacacatcatagacgatgcaggggccacttctaacgattcgcccaattcctggaaagtcgtcttggccggagagaaatttagaacggtatcggctgcagtacgcgcaatagtagattctgtgaagaatcccctaatcatattcagcgacgacggattaatgatacagggcacgatttgcggtcagcaaacattcgttcctatcgagtgcgccgcctttagtgaatttgaatggcgcgggtccgcggccatattcctggcgctaacagattcgaggcgtactttattagacgcgtttaaatgcgacaagaaaaaagcaatcgaggtctcctttacgttccgaggggaaccgccgtcgcgacatctaacccagacagtcacgtatgtaactgataacggatcgttctcgagtgctatcatcaagtatgaactgtggtgcgcctcagttttattcccgcaaaaaattcccgatgttacgttctcagtaaacaaacagcaattaaacaagattttggctatagccgccaagagacggcacgagcaactaacatttgcgttgaaagcagaaggggggttttatgccggaactgtgtgcgatgttataagtttcgatgtagacgggagcgcaatgactcagtatccgtataatgccacgactgcggtctcgtctgccctcgtcttagcatgcgggaagaaaagagccgcccgtaatgcacccgtgactgcatatgggagcggaaaacctttctgcctcgcactggaagacacgaccgcgttccgaaacgtcgtacagaaaattaaaaccggctcggcaggggcagatttgggattttatacggcgtgcaatccaccgatgctatgcgtgcgtccgcacgcgttcggcagcctgaccgcttttctattttgcaactcggattgcatgtctatatacgaattggaggaagcgagtgtagcggtcggcgcagtaacatcgaaacgcataaacgaatattttcccagagtatcgaccatcgattcccggaaaaggcgcccgtcttcggtcctctcggagggggatgggaaactccttaaacccgacggccaataggtctcgtgtccgcgcgcggaccacagtcatgacgcggggaggtcaaactgatataagatgtgataagactgcttagatttcattcgacctggttattcggacatacatggagcccgtcgacaacgcgtctccgttacctccgactggcgcgggacactgtcttcataggattgtttgcatcgaccctccatgtacagcaaccattggcagcgggaggagcggcaataggtgcataaaatgtattatggttacgacgggctccctgttatcgatggccgcacacttgaccgtcaccgtattttgcgtttccgtgattccgtgtatagatcgaaccgcagcctatccacgctgcactatgggcgccatcttcgcattcctattcttttttaacatgcggcttactgcacgatcatcggaaatagtgctgctcattggcagaccgacacaatttttatgcgctctgacagcatcaatcgccgacacggtcgccaaacatctagcggctacccataaggattacctgacgacattgcgagcaatagaagtaatgtctctgttgacttttgtcatgctcggagctctgatcgcatcttatcattacgtctgcatagcaacgtctggagacgtgacgtggaagaccgggtttttagttgtggcggcagggacgattgccggcatcacggctccgtatggagacatttctcctctagccggctttctttcggcgtatacggcgttagctattcacgtggtcagagacgccagtcggtctctaatgaacacgtgctactaccgtgcacgtcgggaaattactgtgaacggtgcatatcgcctcggtcgcgcgcgtctcccgcccagcacggacgccgaggcgacgcgcgaagaagacgtatccagttacgatacgctgggggggaatattcctacgataattctgagcctcatagcggtcatctcgattccagccatagccagctttcaaaagtacatgtcgaacgcaactaagcaccagtcaacattgactgacacgttacgcagtatatgcggtttcttggtgggtacaagtgtcgcgatattccttccgtcgcgctaccacgaggttctgttccgtccaattcttgtattactgttaatattcggggcaatggctactaccttagccggcttcggtttacttctcgggccgacattgttttccgcgacagccgcggttctgtgctgctacacttgtataaatgtacgcaacgcgaatagcggaataaagcaattggcggccgccgcagctggtaaatgcatattaggaactgccatctcgagcatgttggtttgcgtgttaatacaatattcctgatcgcggagcgattaatttttatatcatgtgctcatagcgttctttcgaactgcgaataaaactttcgtggctactaaaggggcctatcgtgggtttatgcgctgtcgaaaacatgaaagggccgatttaaagctaagttgcgcaggcagaggccactccatatacgctctcggagacgcggctcgcacgccagctgaaatattttccccatgcacgcgtcacgcgcgttgcgagctttggggtggacgagactcttatttgtcgttttattttcgggccgcgtcctaagcgctagcattaaccccgatctagctacacccccggtcattgctttcaacccgtcaagtattccggccgatgatgggcctttggccaaagttcctgcatccccgccggcaggggagaaagaggagagccacaagaatgcaagcgacgcgcgtaggatgcctagtatagtttgcgataaagaagaagttttcgttttcctgaacaagaccgggcgtttcgtgtgcactcttaagatcgcccctccctccgacaacgaatggtcgaactttgctctggaccttattttcaatccgatcgaataccatgctaatgagaagaacgtggaagcagcgcgtattgctggcctctatggggtgcccggatcagattacgcctacccgcgtccttctgaattaatctcttctattcggcgagacccccaagggaccttttggacaagcccatcggcacatggagacaagtacttcatatggctaaacaaaacgacgaatacgatgggcgtggaaattaggaacgtcgactacgcagacaacggttacatccaagttgccatgcgggatcctttcaatcggcctttactagataagcacgtgtacatccgcgtgtgtcaacgacccgcctcggtcgacgttctagccccccccgtcctcagtggcgataagtacaaggcttcatgcatcgttaggcatttttatccaccgggctccgtctatgtgttctggaggcaagatgggaatatcgttacaccacgtaaggacacggacggaagtttttggtggtttgaatcagcccggggagccaccctggtatctacgataacgctgggcaactcggccatcgaccctcctcccaagatttcatgtctggtagcctggaagcagggaaatatgatgagtactacgaacgccactgcaatcccgaccgtatatcatcatccccggatatccctggctttcaaagatgggtatgcaatatgtactacgcaatgtgtgccgttcggaattaccatacgatggttagtacacgatgaacccaaacctaatacaacttatgatactgtggttacaggtctttgcaggaccctcaagcggcatagaaatatcatcagccgaatattactccaagatgactggcagaaaacaaagtatacatgtcgtctcatcggctatcctttcgacgaagacaaatttcaagctttcgattacttcgacgcgacgccatcgacgagggggtcccccatggttctcgcgatagcggctgttgtgggactagctttgattttgggaatgggtacactcctgacggctctgtgtttctacgcctccgggaaaaaatacatattactttcgtccgtctagtttgcggtgacattgatctggctcattatatgccccgagctcttgtaacatcgcggacgcgatttccgtagtaggcacatctcaaatgcaaaagcggcatgtcaaccgtataggtacatccggccctgcttacagtcggtagggcatatatccaccggaaaacttcagctttagactcctcaggtgatgaggaatagtatgtaaccctctagcagtacggtatttctaaaaaaaggtagatccttttccacacggcacagactaaataacgtacactacacaggttctctcgaacttcgtttggaccggaattattccctcggcagcgcctaaaaagcaaacctctagagtagataagtgtcagtgaacctaggccttctttgttccacggctggaaagctaagggacgaggtacacgcgaccccagccacgcacgaacagagtttaacggaagcgtcgtttgcgggataaggttgtcggaccccgcgggtccgttgaaaagtggctgcgcgcctaccgacgaatacgtcggtaacaattttagaaatcgaatatgactgcgagtaccgtacaatcgcgaaatacggtctctatatagctactcggtccttaaatatgtaagtatgatgtcccctactcccgaagacgaccgcgacttggtcgcagtacgtgggctgctccggatgatggacgagaccacatctgagcgacacaaacgttcgcgttcaggatgcccccggttgttatgcggttgtacgatcgggatcgctcttactgtgttcgtcatcacagctacggtcgtgctagcttcgctgtttgcattctcttacatgtccctggagtccggtacatgtcctcacgaatggatcggtttaggctatagttgtatgcgcgcgatggggagcaacgctaccgagctagaagccctagatacgtgctcccgacataacagcaagcttgtcgactttactcatgcgaaaattctaatcgaagctatcgcgccgttcgcctccacggacgccaatagcagcaacgtcttccgactacgcgatagtagaacaacgtgcgtacgccccactgccgcaggaccggtggccgtcgactgcccgaggacctgtaccgccatatgccagcggccgcgcccattgagtatcgtcgcttcgataatcagggacgcccgtacttctcttcgtctagaacgtcgcgaatattacgaagtttatacggccattctctcaaatggcagcgtgaaataaacgcgagagaccgagcattagagtagcacttatttattctatcgcagagaaacaccgcgcgcgttcaaaaaaaacacaggctcgagtgccgcatcaccggataacttcgtataatgtatgctatacgaagttatttaattaagtggggataccccctagagccccagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgggtttaaactcaatggtgatggtgatgatgaccggtacgcgtagaatcgagaccgaggagagggttagggataggcttaccttcgaagggccctctagattacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtaccaagcttacctagccagcttgggtctccctatagtgagtcgtattagtaccaagctaattcctcacgacacctgaaatggaagaaaaaaactttgaaccactgtctgaggcttgagaatgaaccaagatccaaactcaaaaagggcaaattccaaggagaattacatcaagtgccaagctggcctaacttcagtctccacccactcagtgtggggaaactccatcgcataaaacccctccccccaacctaaagacgacgtactccaaaagctcgagaactaatcgaggtgcctggacggcgcccggtactccgtggagtcacatgaagcgacggctgaggacggaaaggcccttttcctttgtgtgggtgactcacccgcccgctctcccgagcgccgcgtcctccattttgagctccctgcagcagggccgggaagcggccatctttccgctcacgcaactggtgccgaccgggccagccttgccgcccagggcggggcgatacacggcggcgcgaggccaggcaccagagcaggccggccagcttgagactacccccgtccgattctcggtggccgcgctcgcaggccccgcctcgccgaacatgtgcgctgggacgcacgggccccgtcgccgcccgcggccccaaaaaccgaaataccagtgtgcagatcttggcccgcatttacaagactatcttgccagaaaaaaagcgtcgcagcaggtcatcaaaaattttaaatggctagagacttatcgaaagcagcgagacaggcgcgaaggtgccaccagattcgcacgcggcggccccagcgcccaggccaggcctcaactcaagcacgaggcgaaggggctccttaagcgcaaggcctcgaactctcccacccacttccaacccgaagctcgggatcaagaatcacgtactgcagccaggtggaagtaattcaaggcacgcaagggccataacccgtaaagaggccaggcccgcgggaaccacacacggcacttacctgtgttctggcggcaaacccgttgcgaaaaagaacgttcacggcgactactgcacttatatacggttctcccccaccctcgggaaaaaggcggagccagtacacgacatcactttcccagtttaccccgcgccaccttctctaggcaccggttcaattgccgacccctccccccaacttctcggggactgtgggcgatgtgcgctctgcccactgacgggcaccggagccaattcccactcctttcaagacctagaaggttaattaaataacttcgtataatgtatgctatacgaagttatggccgcctaggccggatcccccaactccgcccgttttatgactagaaccaatagtttttaatgccaaatgcactgaaatcccctaatttgcaaagccaaacgccccctatgtgagtaatacggggactttttacccaatttcccaagcggaaagccccctaatacactcatatggcatatgaatcaacacggtcatgcactctaatggcggcccatagggactttccacatagggggcgttcaccatttcccagcataggggtggtgactcaatggcctttacccaagtacattgggtcaatgggaggtaagccaatgggtttttcccattactggcaagcacactgagtcaaatgggactttccactgggttttgcccaagtacattgggtcaatgggaggtgagccaatgggaaaaacccattgctgccaagtacactgactcaatagggactttccaatgggtttttccattgttggcaagcatataaggtcaatgtgggtgagtcaatagggactttccattgtattctgcccagtacataaggtcaatagggggtgaatcaacaggaaagtcccattggagccaagtacactgcgtcaatagggactttccattgggttttgcccagtacataaggtcaataggggatgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactggcacgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttcggtctgaccaccgtagaacgcagagctcctcgctgcaggcggccgctctagaactcgtcgatagcagcgatgggctccaaaccttctaccaggatcttagtacccttgatactgatcactcggattgcattgatactaagctgtatttgcctgacaagctctcttgacggcagatcacttgcagccgcagggattatagtaacaggggataaggcaatcaatatatacacctcatctcagacagggtcaatcatagtcaagttgctcccgaatatgcccaaggataaagaggcatgtgcaagagccccattagaggcatacaacagaacactgacctccttactcaacccccttggcgattctatccgcaggatacaagggtccgcgtccacttctggaggaaggaggcaaaaacgctttataggtgctgttatcggcagtgtagctcttggggttgcaacagcagcgcagataacagcagctgcggccctaatacaagccaaccagaatgccgccaacatcctccggcttaaggagagcattgccgcaaccaatgaagctgtgcatgaggtcaccgacggattgtcacagctagcggtggcagttgggaagatgcagcagttcgtcaatgaccagtttaataatacggcacgagaattggactgtataaaaattacacagcaggtcggtgtagaacttaacctatatctaactgaattgaccacagtattcgggccacaaatcacttcccctgccttaactcaactgaccatccaagcactttataatttagccggtggcaatatggactacttattaactaagttaggtgtaggaaacaatcaactcagctcattaattagtagcggcctgattgttggctaccctatattgtatgactcacagactcaactcctgggcatccaagtgaatttaccctcagtcgggaacctcaacaatatgcgtgccacctacttggagaccctatcagtaagcacaaccaaagggtttgcctcagcacttgtcccgaaggtagtgacacaagtcggttccgtgatagaagaactcgacacctcatattgtatagagtccgatctggatttatattgtacaagaatagtgacattccccatgtctccgggtatctattcttgtttaagtggcaatacgtcagcttgcatgtattcaaagactgagggtgcactcactacaccatatatggccctcaaaggctcagttattgccaattgtaagataaccacatgtagatgcgcagaccctccaggtatcatatcgcaaaattacggagaagctgtatctctgatagacagacattcatgtaacgtcttatcattagacgggataactctgaggctcagtggagagtttgatacaacttatcaaaagaatatctcaatactagattctcaagtcatcgtgacaggcaaccttgacatatcgaccgagcttgggaatgttaataactctatcagcaatgccttggacaagttggcagaaagcaacagcaagctagataaaatcaatgtcagactaaccagcacatctgctctcattacttacatcgttctaactgccatatctcttgtcttcggcacacttagcctggttttagcatgttacttgatgtataaacaaaaagcacagcaaaagactttactgtggcttgggaacaataccctcgatcaaatgagaaccactataagggcatgagcttgatctagagcggccgcggggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttcggatcctctagagtcgacggccattatggccgagatcgagtgccgcatcacggggtacgataaatttacgcggccgcgctatgtttactttatacatcagaggtcatcgtcaacctgcgcaaaatttccgttaccgtaaccgtgccgccacgatgcttgcgcacggcttttgggcgtggaccggtcggtgcctccaaaaggcgttcggggggcgtttcggggaccgtactgggagatccgacagccacggcgttgcacatatctgccggaatcgccaatcccgtcgtagaagcacaaccattcctttcaatcgaaaaagtggcagggagggttgcggctcggtccgatgcgggcgaaggctccgcatctgtgcgggtcccatttgacgtagatgccgtagtcggtgtcggggagcggagataagttagcgagcactgagcgggaggcggggagtcttgagtgaagtgcatagtgaagatggactgtccattagaggcaggcgcttcactggtctcgcccccgtcctctacccacgcacgcttcgattgctggggcgagtcttgcaagcatctaacgactgagtcacctcccttagccgcgggttggtaggtgaccgtcgacttaactcgtgcgtgtttgaaccagagcgccaccgtggattccgtgtcagcccacgtgcacgagttcatggtcggaaatagctcccccaggaagcactggaaccgtttctgttgccggagagcacgtctcaatgttgagttagccatgccgccctgcagccataccgcatacccgttaaagaccatgttgaggatatattgacagcggtaattcaaaagaccaaccaacgccacaatagcgactacaggccgcgatacttcactttctgggctgcttcgccacgcgcagcacgtccacaaagcgcccatgtgaacaagaggggctaaaacggttccgataaaatggcataacatcgtagtgtcggcccagctttccgatggtagggaactcacggcttcggcaagggccaaaaatacggtatcaaagtcgctcggggcccgagggccgaagacgttagggcacgcgcgcagatctaacacgtccattagccacaccgcccacgtatacaacgtccttacataactcagcaatagttgcaagcgtatcgacgtatcggcactaggcgccgttacatcatcgggtctcatgtagtaggcgtatttttgaataagctctgtcccgtcccgaatctctcgccaacatctgagatacagtgcattatctttcgcgagttggaacggtttcttgaccaaggcgttacgattaatgatagggtaaaagagcaatgctgcttcacgtctagtcggatcgcaggtctcgggcgaaccggcacggcatccatcgcgtctcatctctaaataattcatgtaagaggcctgataacacctcttgaccgacgcacgagtcagcttcttttttttcatacggcgcgcaatgcgcgcgcggtagggcctcgtatactcttccgaggcatcccctaacgcgaggtagacgacgatacattccggaactttgttagaaggagcgtcgcgcaacagcgtttgtcgcaaagcagagagaaatcctgaggggagcacttctacgagcgcgtcttcttgagctcggatacccgaaagagatgtacccgttgtttccgatagctgacacgggtactcctggacgcgcgtcggcgaacctcgtgaccgggaatttaacgccaacgaatccgtctccggctcgggagaagttggcgtaaacaactccggcgacatgctagcgcaagcatatcggtccatcggaatctatacagattaggcgcagtacggaaaggccgacttttgggacgcgaagtggccagaagcatcgctttccttagcacaactattcttaaatgcgatgcttactcagggcggattgatagtcccgcccatacggcgcgtcaccacgatctgcacgccgctccgtgcgctttttttttaccggtccgtttttttgaagatcgcctccttcgcatcttctaacacatcctgcagcgaggctagcgtgccgagaaggttatacccgctcggaggcggtactagctttagagcttccaactctccattcttctcctctccacgaatcgctgtcgcaatgccgtcgggcgggtctcctcgctcaaattccaattctaaatactccatagcgtcgtcgcggtcggctatatattcatctacgctaacaggtcgatacaagcctttacatacgtagcacaggtggcggtatagcttaaacgtttccgaccaaacgtctacagcgaggtcgtggtacatggcggcgatcgtgaggtgcgcgacgccgatattcaaatgccctagcagacgttgcagaacaatggtagtggctaccacggttgcggttaaggtgtctcccgactcgatatctctctcattcgccgaggtgctgcgcgatacgaactcgttcataagctccgtaagcgcagatctagtagcgacataagccccgacgaaagtctcccctagcggcgcgcccccggtaccataagaagctgattccaatctccccaggcacattccttccgcataaagaacatcgaggctctccattgggagctttttatgaccacggcctagcagtcgcgcccacgcgcgaacacgattagctttgaaacggtgaagcattcgacccgacgaaacatacaggaactgcgcggcgatactagcagccacacatcccacagtaacgcacgacgatagcatttcaagttcttctttcgtcacagacaccgtgtcagacgacactctcgacaataaaaacacttctgcccgtagcatagcggcagcggcatagcgcactgcacttttacacttcgatcccaaaatgcaacggagttctggccagtacgccagagagccgtaggaagcacgtaaaattgcagcagcggggcccttcgccttacggatagcgccgccttcaaacattttagcgtcacccgtaggaacgcgtggcaaagacgacaataatttggcgcgaccgaatttggaaaagccccctttatgtatcctcaccgctagctccaaagccgaggtaattaagaaaataatagcgtctttctgattcagctcgccagacactacggcactcctcagggcatctatcccgaggcagagaataagcgcgtgtgcttgcttcgccgtccgtttccaggcgagagcgccttttggtggcgcggacgtatacatatcccccttggcatagtctgatctgctgtcagaatgccaaagtggaccgtccccgaaagtattgccccgggtatgtagtaatttgtcttctcgtatagcctcgactcgaggcacgggttccaacagccgccgcaacggaatgaacgtgccaaggctctcgataaacgtcggactcgtgccttcgaccttgatgctattgagatcgggttcggccgataaaggggaagggaccgtgtaagcagatacgacccgctcgtaaggccgtaaatcgtcatcatctcccgaaaagctgtcgcttcccagagattgactcttttctctagacgatgcacccgagcctttacttatccagttctgttttaagtcagacggcgcacgctccaagctgctgtcgcgattaaatgaggttcgatcctcatgaccgccggctctcggtcctcgcctgcgtgacgatccgcggcgtcgtccgcgcacgcgcccagaccgagccgcatgtgtgtattccccccctctagatgatcttcctctaaactggacccatcttctggatcgatggcgaccttcagagccattcgagcctatcgaagaccggccagaacccctagaataatgcgtgcgcacgctagcgtttcgatgtcgccgtctagatgacgacctccgacgtctagacctaggtctcgacctcgatgaggcgtctgtcatgtcgcgcgacgcatcccggcctgaacgatccgaagagcgtccctcccgatctctgcgatagtgcgtatgagcactagcgttgcgatgacgacgcctagacgaagaccttcgccgtttagaccgaggtttagatctcgacgatgcgtctatcgcatcacgcggtacatcccgtcccgtatgctccaaagggcgtctatcccgaaaagtatctcgaatgtagccaataaacccttgtccgttgcgacgactcgtagatccggcagagctcctatatccatcagtctctaggcgatcgtacgtatcgtcgtagttcgtctctgatggtcccacgtgtatgcttgccatgttatagggacttcgcgataatcggacacgcgttttagttccgcgcgttacataatctcggaccgaaccggttctctgtcgctgctcttgaccgacatccccatgacggtgtagagccagcattcgccttcccgtcacaactcaccggcaaagtacggcggccgtccatcgccgtctcattttatacggtgcctaatcgaacggcggaaccgtagctatatcgaccgcgttccattgagaagggggcgcgaggaacggtaacgaagtaaatataataaaatcatttattagctgtcgcttttacgtacaacattgttttaactacaaaatcgtaccgtcgcatcaagtattacatcaccgtttaccgttcgcggcttacattgtgcgagcagcagcgatatcctcggcaatcgcgggcccgggatgtgtagaatcccgcaacatcgctttcacgatagtcccatggccacacgacgggccggccttcccagcgcggccgctctctccccgcgctgatgatcgcggtcttggagggtgcatgagagagtacacttccagctttgatttgatgcactggaatagatacgcggatgccctaggcgcgtttgctaaaaatgcaggcggggctgtcaaaggcataccccgctcttccactaactcgcatcgcatcaccggcagtccgagttcggaccgtacgtaattttgtgttcttaattcggcggcggttaacgcacgcccttcaactatcacaacgccgtggttaaaaataaccggttgaaataaacactgaaagtgtcgtaattggtgccaatcgcaccgcaggtgtgcaaataagttttgccttttcctctgactggcttcgagtcgccgcgatacatctcttgtaaccgaaaggtataaatgcatatacagaagtcttgcgaaccttgccgcttcccggtaatacgccccggcgatagatcgccggggcgtctctgacctgccgacgcacatatcgcatcgcgagggttcgttcgctccctgcctaagataacatgccaaagcacgacaataaccgcaaagtagagtgacataggatttttctctagcttccaattccatcgaaaagaatttttgaatctccgtaacataaacaggcaagccgtcctttgttaatgggggccgcgggacttccatcccgcaatgttcgtttagatttatcgccgtatatgcccatttctcttcggacgccgcatctaggacttcgctaggagagacggacagtagggttgcatgttcgtataagtgcccattaatcggaaagcacgagaacaagtctacgtttagtttttccagccgagataacagggacgggccctctgtaaaatccagttcgtgcaagagcctgttgtacaagcggttcggaggattcggatttggggacggaagcgaaattttgatcgaaaatggagcactcaaagagaacgaggcagattgctccgcgcatctcgtttgagagcaaagagtttcgctaaagctttcaatgccgcggaggatgtccgaatccaaacagtccgtcattccgtttacgggcgcttcgatctcggcggataagtccgtactgtcgcggcgagcatctcgactccccggtcccattctccgcgtcgccatccatctgcttagtagcgcccgccccactaccgatactttatgtgacgctattcactctcgctactatagttaccacgggaacttgagtagtggcgacgtgaagtcgtcggagcgcgaccgggggtttttgagcgacgatctctcttatctaccggagtgctctcgtcaccgtcgcgttttccatattgggatctggacttagggtttcccatatccggcgacagtccggactcctccgataattttcgcgtacatgcctcagcttcatccaataggtttgccccttcttgaatcgtgatcttgattatagccctggcgaggaattcctcgagctccgcattggtcctcggggcgttccgacgccaaagggaaagcgctcccctatatgcatggtactgggccacagcagctacggctccgcagaatatacgctcgttatagacgagcgtgtttgatcgccaggtactagttgctgacgccggagtcgtactaaaggcaaatttccctttttctattgccctggctccgggtttggcacgaactttggaggacagcgactcccctctttgggtttccgatgaggaatcttttctttcgatctttacagatctgcgtctttgtaatgaatgagacgggggggagatccggtccggcgactcgttcttggacgaatctcgtcgagcgcgggtcgacgatatatgggcactattatccggtgacgtgcgcatagttgagcgacgtcgactcgacttacgtctatccgaatctcccattgtatctcgtattaggcagccgattacagacgcgacgggccgttacgtttcaccgtgttgcgtctccgacactgatcaagctgttcacggcaatgacattcttatacgggaacagtagcgcccacgcccacacgatcttaccagccgtcatcgaacatacttgccgtgaatagtcggaagcatgcatggtacgacccggccaagagggcggagattaccgccaccagacctagataaaaaaggaccgagaagccagaagaaaaggctatagacacgcctacggcggaacacgtagattcccagaaatttcctgccacggcgatcggccttcccgaatcgatcgaagtagctcgcgactccacgagggacgcaattacgcaaattaacactttacagaccacatgatggatgtcggacaaacccatccctgcggtaacgctttggaaaagatgtcctcgcacgcgtcgggggctccgtggcgcatgcagttctccgtcgatgaagcgatatatgcgaggaacccagaaggttggacctgttatatagaagaacgcgacccgcgctgtcttcgcgttatcaacgactgtgcgatctcgttgcccaaacgcgatgttaagcggaagtatgaaatatgtgcgttagatctaggtgtacgagtggcagttcctcggaattatgtcgttgtgctggcgaaattgacggacccggatccaacgtctcggggcgtacccgtaatccgcgttgccaatggactaatagattctggatacagggggaacgttcgagtggtacttttgtacgaagcagcttgcaccattcctaaaaacgggctggttatacgtctggcgctcgtgcagttggcctatccggatttcaacagtcgcgtgctttttgacctcgctgatatcacgccccacttggattgcgggcctaacttttcgatgtcgattgcaaccgctgctaaatcgcacagcgctcaggctcgaccgctattgccccctggcggcgagaaactatggccgggaaccgggtgtcgggcactcgtctgtttgtacagcgatcgcgtgtctcgggcaactcattataacactttagacagcaatgtcatatttgccgtaaggtacaatgattctacgaccgttatcggcttaaaagatgtcccgaagtatgtgcataaaacatttgtacggttttatacatccggtcaatttgcaacgttcgttcctttttacgagacatttaatacaaagcggcacgaagatgcggcttacgatatattcgctccgagcgacattgtattggaatcaatgtcttctgtaactatcgcgatacagcagcgatatgcatgtgcggataagtcaatggttccttggatcttcggacggtcgtccatgaatttgcgcgggttgattatttccccatctaggtggatgcccgattcgtggttaacgctgactttatgcaacttaacggaagcaaaagcgaccattaaacgcggagataggatcgcccagctgttgttagtcaatcaggaagccgctgcgttgcttccaacggaaggcggcacggctgcgctgttccctacagtaggtaaatgccgtcgtcccgcagcgtccgcggaagctaagtggagggaaacggcagcattcgatacggaatcgggcaggagcgagagagagtgtgccggcttcgggtcgagcgggcaataatgtatagttgcgcacgattacatacaaaacaataaacacgaacaccacgctgcgttctggacaatcagtttattcagttacacagtccggtaacatgccctcgttgactccacatgtcttagcccttctaccgcttcccttacttacatcacatgacgttgcacatgccgcttgctcggcttcagagtgcggcggcgaaggtagccctcccacccgaccgtaaatatctgctccactttcgtccccgcagttacgggggtcagtagcttccgatagctctaagttttccgtttcgggacacgcggccaacgcttcgagcgagcaatcatttggggaagattttaagcctaacgctctttccactagagcgatatcattcatagcagtctctgtagcagcagttatttgtatcgcgtgttctacgaaggcatccgttcgtcccgtgccgacagacatgtagatctgcaagagggcggcggcacacgtgtccaccattcgctgcgcatttttgcgatgggtctcgacgaccgcgtcgagcccaggggttccttgtcccgaaacatgacgagataggcaatcgagattacggagacacgcactgtacattctagccaacgactggccacgaaccagttttcgcactccgtcggcagacaatatcgccatttctaatgtgatgggcgtggggagcataagattgacggcttgtaccgcctccctgaaacgatgcataactctgtcggaggaagacgaggtagacagtgctgtgtattccggctgaatttttctagagcgccttcttaacccggcgtgcattgtggccaaatcttctattatgtccgatataccggaggatgccgaccctgggatcaaagttttgtttgccgttgatggttgcgccgtctcgttctcccttgcacttcttacgggtcaggtcccatctatcaatcccgtctacgttatcagccactgggatccgggcaatcgtttgttagatgtcctttgccaccgcgcagacgatcgcgactgcggaagaataccgaatgaacgaggagatttaaacgcggtctccgaccctctaaaagtagagttttgccttctcagtcaaatgacacgcggtttgggcggcgccgatttaaaattgcggacgcgagcgatattcgtgtgccggtttacttcgcattccgagattaactccatcgtggcttctatagcttccggagcgcctattcaaacagacttattaatagccaccctctccgaatatgacacatttcgcctacatgatgacttcaacatcgccctccacatctctctcgcctgtttatcgcaaaagcgccgcaatgggaaagagccggcaaaatcaccggatcgaaatctgctatcgattatggcgggaaccttttctggaggtcggcgcggtctagccgggctgtatttacaatacgagcaaaaagtcaccgcggcctaccgacgtgtatatggggggtcgacgacgacagcgttctggtacgtgtctaaatttggaccggaagaaaagagcctggtcttggcgctacgttattaccttttgcaagctcaggccgaacctactgggattgctacgggttacgatttacaggccataaaagatatctgcgacacgtacgctgtacccgtagaggccaatcctaccgggttttcgacggcagacttgacatcgtttgccagattatcgcgtttctgttgcgtgagcaattatgccaacggtcccgtagctagggcgtttcccctatacgtggaacacagaattgcagccgacgtgacagaagtggatgcattgaaagagtatatagaaagagaccggtccgggttaaagatttcggatttggaatttgtcaaatatatttacttggcttacttcgagtgctacaatcgtgctcaattaagacgtcatttgcgagacgtgaccgtgcgttgtcccgaagaagatgtctacaaacgctcgtctctggggaaacacgcagtcgataatttctttacgcatgtgagatccagactaaacgtgaacgatcacatagcatgtaacgtatctccggatcaagtggaaatgggaaacgttttgacccgagcattttgtagggccaggacctatccaccgagtaccatggaaagcgatgcgcgtttcaccgggatttgcgaaccctcgtcggtgattataaagcgtctggatgccctagaatcgacattacacaaatacggatggccgcgcgcacggtctgaaacagttaacatgatgtcagagtgcgcgaatttgcccatcgcttcatctgccgatagtcttaggccacccggcctgccgctagaacatccaggcactcattgccggggtggtccaatgatcgtaaagcgcctactagcgctagtatccgcagatgcacgtgtcggggacataggaccgacaaacatgctcaccggcattcgggaatcggccgtcaagggccctcttccgatttaccggataggcatgtccaaaggcaaacaagcgtttgccgtgatggtggccgattgttgggacaaaatcatcccgtctccgggaattgtgaaagcccatctctctaaactcggcagatccggtagagcccccgaagacgatgtgatcgcccgagatattttttttacatcagaacttgagcgagtcacgggccatgctgcggaactgccgtactttacctgcggccctgccgaagaacaacagtacataaatcgcaacgaagtgttcaatgacaatcttattgtggggaacataatcctggatgtcgatgtgcacttacgaacccccgtacccgtcaaacttttgcatgtggcaatgagaggttttaggaccggtgcgctcaaagcgttgtctctattacttccaaaagcaaaaatagatcacggctcgtacccgtgctacttttacaaaacctcgtgcaagaaatctcgagtcgtgcacgtaaaacattggatgtcgtctactaccgacttcgctctcgactgcgacggtcccgccgtcgaaagtgcagactgcgaactagaaatgggcttcgatgacccgttacttatggatcaaattgatgattccatcagtagatgtgagtcagatgcatcaagtttgccgtcggacgccgatctgccttgtaactgtcacgaaaaaataggattgcgggtctgcattccggtgccgcccccgtatctactcgtaggtagcagaacaatgagcggtctggctagggtactgcaacaatcggttctgttagaacgtagtttcgtagaacctatcggttcgtatctcaaaaactatgatatagttgatagcggagtatatggtcacggtcgcagcttgcggcttcctttttttggcaagatagacgagaccgggcttatatcaggccgcctgcttccgttttgcgtgataccggagcgctgcggtgacgcagaacagttcgttctgtctcatttacagcctaaaacctttcacttccacagtcccatgcccgaagaagatcacgcgtctgtagttctgaagggcctaggcggagagtatgccggattctttgaaaaaaaaatcacgatcaatagagatacgtttttcggaatcagattatccttagcggtagctctgaaagccaggggggttgacattaacgactctgcggcaatcgtatcattcgtaacggagcacattttagatgacataattcagtacatgcatgaccacatacccgatcacgctgcggaatataatcacgtttctgtttcgtgctgcgtcattagaccagattggatcctcttgcagctaatggccaataaaacattgggacgcgctcacgggtttacgtgcgtgaggtttaagcatacaagaacgactcgaatgagttcgcgttcgtatttgtctttaaacatcgacgcacatggtaggttgtgcgcgtgtgtgattcagcagtgttttgcggccaagtgtggaaacaataaactccgtactctttttacggtggatgtcgattcgaaatgccaggcagaacatcgatagccctttcgggaattatactctgcatctcgacatacgccatcgctttggtgatctacacgacgatgatagctaaacacggttctgggtgcatctatgccgtcctggtagacagcgatcatcgcgatgccaaaaattttacatgggagccatacaattctacactggtatacacgccgctggggaataaattaccattggacggaggatttggcggttttagcgatgtatgtaacacatatctgatcaacgcgacggatttattcggacgcgcgtctcacgcgtccgccaagtcgaaaatccgttcggtggtaggaacgcgcaattgcgcagcctacttttggaagacgcatatacaagccttgaccttttccctaagttcgtacattatgttttgcgtcattagagaatggagacgcatgtttggggtggtgcgatctgaaaacgacagaataccgccgacgacgtacacgaagaattatactgccagggtaatcgctaacggattgctaaaaacggtatatactagaatgtctgaatttatgtgcgagattactatatacaaaaattctatgtgcagaatatttacagacgaccctatctcgtttatcttacgtcaccctttggctgcgattctccttataaccgagcggctcataaggctcggcgcacagtgtctgtgtgtactaacggtatcgattttttttgtaccgtgtaaaatagttttatcgaaatggttcttgtctatcaccggagttttcttaggaatcgttatttgcaccgagatgggcctgctgatagacccgggaccggctgaaaaacctgtcatgtttgcagaagttgccccagcccccaaaacccagcagaacggcgtggctgtcccgttcggtgcacacgctgtatgttccaattgctgcgcctccataatctccagcatagtcatcaaagttctgtacgtgttattcatggttaccctcatcgttaccctcgtgcgatatgaacgagcgctccagattgccctgttcgggcgtgcgtacctaccctaaaacattagtggccaagcctcctatttgcatcgcgcggatgtgacacgctaaccgcgagaccttataaatggttccaatgagtcattcgcccctcgggtgtacgcggtattctacagcagcgtattagataaactacacgggtttgccgtcgcgcctcaaggaaaatgtcagtgggagctttctctcgtgattgggacgatataatgagtttgtcagactacgattttacagaggaagaatccttagatgaaagcggcgaactgaaagaattcaagaacacgtccgcgttgaatgctattgagacagcccgcgacgcaattgaaagatcagccaattcaaacccccccatcgaagaaccgtcgttcatctccaaatctcatgcaggcgagacctcggcctcgaaatatagaagcttgcccctcgacatcgaaaaggcagaacggtgtgatgacactcgaggctacaacgtgagttcgggaaaacgaatgcgtttggcagtttcggccactgttgacctgtgcgagtctgagatcgaacggcaatgtctgaatacggaaacgcgggaccgtgcacggtcccccaaacattttgcatcccattatgaaatcgccgccaaaatacacgatcttcccagatctacgggaaaaaggcaacggcatcgcacgttagattctcgctcacgacgccacttagcgggagagcatcggcggcggggagctcatgacgaggaaagcagacacttttccctcagaatgcgtgaccctcattcagcacccggcaagagcccgctgtcgaaaaggcgcagtcccgttaggctccgtaacctctctgtgcaggaggaacttaacgcgatgctacaacgagagaaactgaagctcgacatgatttcgagagagcgcaatttccgcacttctagcaaaaaccgctgggcctcagtactggcattctcctgtaccggaaaaagtggggcatacgggtctcagataacgtggcaatatttgcttcaagagggaccggagcttagaaagacgttcgaaaatagacctagaacctcattgctggcgtctgcggcgcgcgaagctgtgttgcggggcgaaaacttagttgcggcattggagagcgccgaggaaaccctggcatggctgaaattacactctgttctaaaactgcgtttaatgaaccatgaccctattttcaggacggcgggtgccgtcttagataatctcaagctgaaactcgcacccataatgatgtgtagaaatggtacagacaaacggtcgttaggagacatgctgagaagatccgccacggacgatatcgccgattcattgaccttatgcttaattttgctatcgcgtattcatcgcatgatgatgtatcgcgtgtcgggtagaaaagatagttccatgatagatcctcggggatacatgagagagtatactcctggtgaatgtatggcgggtatattgcattacgtagacgcgcatgcaaaaacgtgttccgacagagcgtgcaatttatatattagctgtacccttatgcctgtttacgtacacggcaggtactttcgatgcaattccgcgtttgatatgtaacctactacagacgggcaattttgtattcttcaatagctttatttgatatccattaaacttaaataaagacaccgatattcaattggacatgaacagcgtgcgttttattttacacttagcctgtgtgctttcgacaccgagtaggaaaacgaaggacctgaaattgcacgcacgaccgaaggaaataagccatcgcaatcgcatttgaaatccaagtaggcaaattcaggagaacctatcacttcattgaacaagttctcgagtattcttatgaatgataagcactggagcccgccagggcgatcgcagacacaactaattaacatgccgtgagtgctgaagttctctctcatggcagattcgcataagtaaatagtcttccttcgagttcctatctccgtgaatctgcgggggttcatcagaagcgcaggtttgatttccgacgtgtgattagaatgaaattgtcgaaagacagtctttagagtcattggcatgtctgtcagtactatggacacttccttgcggcagcgatcggtaaggaaccacagtagttccttaggtagtatgtttctacctaggaaccacggtgttcccacggccaaaaaccaagcgtggtcaaacgatccggtgctcggagaagaacgctgcgtatccgctacccaaagcagtatcctttcgcagatagacgacgttgccgtgaccattctccctttccaacctcccgtcagtacactgtttattgggcccccggcgtgcgtgaggagtaccggtctagcgactattccataaacgttagtcggtgagagttctctcggggtgagccacattgggaagcccgtctgggttggagcgtccgatgtagagtcgtaattggcgcagcgctgaccctgcggtctacaatgcatggtcatgctagacgggacaactagtcgcccggtgcatttttcattacggccatcccttacgtccacgtaccacgtgccgtgagtgtgtaggtaacacgtagtgggcgtggaaaaacttatataacacccggcagaaaccacgtgcgcccagcggtggcagatcctcagttctacagtgtccaatggcggaaagtacagctgaaccgtcagcttcaccggtacgaattccgtacgtttggcaagtgatcgctccgttagcaattgacgtgccgtccgcctctactcaactagctacgggcgaacatgtgtcatgtgccgcatccgttattcctcgttcgtacgtcatacgggcagcgtgtaaatcgtcgacgactttccacgcgttcttctttggattggcgacggatccgtctgagaacatgtcccaatgcggtgcctcgtatatcgcgtatagaatgaacaagaagttacggactggtcgattgacaggcgaccaatgcgagtcgcctttttctcatgcgacgatcatcgactcactggatgaaaactacagcatggctatagagggactgtgttttcattgccactgcgaaaataagttttcgctcgagtgttggagatcggcttttagcgctgccgaaaaaatcgcatcgcagtgcagagctattcgcgagtacggacactgaataaaaacgaatcatgatttgatctaccatttcagcatttattggtttatacattctcgggttcgtatgtatacaaaatcttatggcaacccgcgataacaattcatttacgcataccaattgcgagagctaggggcgcaccctcaggttcgcctacgccggtatagcgttgagatctaatacgggagtagtgattttgcaggaatgtaagtggtagtaacacctaaagaaaaccacatactaacgctctactgttcactcgtatctacgtgcagtgaggttcccgcatatgtttgcgcgtcatcaatcgctctcgccagtatcgccacaatgcgtttttcgcgcgcgggtattgggacgcagtgtaagtggaatagcattccgcaggcaaaaaagttgtttgtcatgcaagcatccatcaagtagcaatcacatagtgggaccagacgcctcaaagcgacgtagtggggggaaccctcttcccattgcaaccactttcgaaatctgtaggtatatgctgccagccagcgccttgttctgacggttattaccctgaaccccttaaatgggaagaagaatccaaggtaccaatcgttggcgactggcccgtgcggacaacgggttaaggatgtgacaaactgtgtttgcgtgggtacgtttacgatgtatttcgaatcccgcacgacgcattcctcccagtgagatagtagtatcccataattcatgcatctgactaccttgggggtgagacacgctgtaatatgaggcgtcgcttgtaaaacgcacctgtatggaaccgttccgagttcggggattgattctatgatagcaagtctacttattccggaaaccgccatgacatcgcacaaaggaagcagttggttaattgcatgaatcagaatgtttgtttccagcacggcacctccaaaggaaaataatgtttcgatgcacgttcgtgccccgttctctgtattacagcttactagcgcaaggctgaggacaaaaacgagttcgggctttgtatgttcgagcggaacaccaatgcgacataccgtatcgcttaagtttttcataaaagtggatcttgcacgtttgccagatctgctccaatcggccgaaaaaaatttgcgcacaatcggatgcatgtctgtgcctacaaataccatgaaacataattcttgtgctggacccccatccccgctatctatatctacattgtctgacatgtgttgtgccgacaacaaacggtgtcttgtatccccatcaatccagcgctttctgaggtttacgggctttaggatggacacatcaccgcatttcggcacgcataacgcgggcatgtctgaacgggcaacgattctctctgtgagcagatcgagacggccgtgacgcacaccacgtgccggtacattaggcacgactgtagcaaaaggatggtagcgatggagccagcctaccgacagtcccgcaaaaaatcttatcggcggaatgtctcttttaaggggtagtgtgttacgaaccgatgaattcaatttctctgtccaaccacttatcgcttccgcaacagaaaaatcgtttctaagttgcgaatatgtttctaccacccacttgagatcgctgcgaagggcttccgacatttttttagcgtattcctcatctccatcacaatcacagtcgtgtctttcatttgcaagtgtgggcgcgcagatgtctacgcgacgacttaaccgagacactgtttctctagtgtaccggtaacatggactggcgcccgctctgaccgttagcatgcgtttggatgcaaccgaggttagataaacgtctggagaactgcccaattctttgctttcactggcacatatccaaccgtatgtatcctctgtctgtcctgccgcctcaaagttaccggggagaggtccgggactcgctagacagaagtcgatttgggaaaattctgtgtcattgttgtagggactgtgcggcctatctaccatagttgcagaatcgtgcattagaatttcagcgagcatggaatcgatacgttcgtcggcacccgcatatacggcacctattcctattcgcgtacaagagtcatcttctacatcaagcttccagaacgttgtcaggtattcgccataggctgcaaagtctgcatctgtggttcttcttacaaattcaatctccgggttccaacgtccacgtcccatacataggttgcgcaacgtgatcgagtacgccaacgtattgaaatcatttatgctagatgcttcgctattatcttcgaacaaaattatcgtatacaatttcgattgatgcatcgatcgaaggactgacaaatctgtcgcatatgtctcctcggggagaggtgtgacggtgataggctcgtccctacgttcgaaccggataaggcctactgtagcggtggtttcagtagtcctgatgcatcgtaaaattgtggcctcggttctaattttcccgagtaaggcccacggaggtccgcaattactattacacagggcctggattacggaggaagtgccagttggtgcacaccgaaactctggaaaccattccttggacggaataggagggtggaatttttgtcgtttagtccactccatctgttcgtacatggaaaatcgtgttaattcctgatcgtcgaaatgtgctaatggagctatagtgctgcgttcggctggtgcggaacctatagacacgacatattttggttgcacgtgcagttctctgagctgattaggaaataatactgcgtttgatgatagcaaagacctttcgggatcgagctccggagtgcagtgcgaagcgtgaacaattctacttttcttccgagacggtgtgaagcaaaacatcttgacgatgctacgttctatggcattctgcaacaataaagtatcaaattattttgacattatcatctatagtatgagcggtgtgttatataagaggacgaaacacttgtgaagtagacacgttttattcaggaactcacattttcactactacgctgttgtgagcagagagataagcgcggcggaaaaaacagtcacaaatactactgttaatataatgatcgcagccgcatcctgtcgggcattaaacaaccaatcctcttcatcattagtttccgaagagctagtctcataaggcggcggaggagagtcgtaggtaggaggtggtccatttgaggcttcatacggaggcaaatatgcagcgtcgcattgaccgtcccccagttgtaattcgaaatgttcatataccgattccccgggagcgtctaaaaatggttgctcctcatgtaacgcttgcgcttcgctcgtcagaccgcggtctagctctgcgctcgtaagttcggtttgcggtcggtcgctatccattttccctcgcccgcagtaactgtgtcgatggttcactactctcgaaggagttaaattgcctactttctcctcgaatctcgaatgtggctatgcagcatcagggtcattagcgtcagtattttcctctttggagtctatggctctaccccaaatacctcccgcgattgctcctgtgcataaggccataaacaggccggccctctgccaacccgttgaatccaccttcactgctctgccaattagtattcctgcaaaaaatgccatgcatgatcccattactaatgatcttgcggaccgaataagcgtgattaccattaaggagcgcattgtagcattctcagattccacagataaaacagtacgaggtactgtaggagcaaggcgctgacctacgaggttttgttgcacctttcccgctcctttttctgctatcatcagtaagttaatggactgcacgatttcgctttcggcccggaggaggcggcgggcatcttgtaccgcgcgctcggcgcgccggagcaggcgcgcgtgcgcctcgtccgcgtccgcgcccgcgtccgcgcccgggtcgtcgcccgggtcgtcgcccgggtcggcgcccgggtcgtcgcccgcgcccgcgcccgcgtcgtcgcccgggtcgtcgcccgggtcgtcgcccgggtccgcgcccggtccgcgccctccggcgtcgttctctccggcgtccgggtcgccccctccgtccccggctccgctctcgcgctccgcatccctctcggcgtccggaggggcgcgcggatcagcggtcgggtcgcgatcgcgtccgtcggatcggcgccttttcccccgccgcatcgcgttccgccgggccggtcggacgggagaagaagggggagggggggaaggaggagaggggggagggagggtagccggccggcctgcagttcgggaagagcgggggaggcgccgtccgaggccgccggggaggaggttgtggggggcgggaggatgtgtgggggaagggaagggggagacggccgaaacctacgcgttcgccgcggcgtccgatccgggatcgctcccgacggggctctcgttcggcgatcgcttatcctctgccgccaccttgcgtccgttcgcgggaagcgccggaccggcgctctaagcggagatccggcgcctccgcttcttatgaccgggccggtcgtgagggcgtaacgatcacgtgatgcaatgcaaacgagcggggcgaacgcgtcagcgttcgcaccgcgaaccaatataagattatatatataatatattattggcgcaaggtgcgaacgcccgtccgggccaatcgggaagcgggatcctatgccacgtgttcgtgtccggccgcggcccgcgccgggggctagaaacgccgcccccctcccacgggggcggattcggggacctccggcctacaaatacgcgagcggaggtccggcggggaccgtcgttccgctggccggcccgccgtccgaaagcgcgggaccgcggtaataaagcgcccgccgtcgcggatcggattttctggtcgttcttttaccgccgggcgaaccgcgcggcgaacgaacccgtcccgttgggatcgcaggcggccgggaagcgatcgcgcgccgtcccgagaacgtcgtctacggctcgcgttcgcgggggtcgccgacgggtggaagggggatgggtaccgagggcatcgaactggccgagctcggcatctccgccttcgggccgcgaccctcgcggcgtccggaaccgtcggacgtcgagggaggacgccccatcgttctcgtccgcggatcgtcccgatccctcgcacgagaacgagatccgaccccgcgtcggcgacgcggccgaacgccgctcgcggaacacggtcgcgggtcgccccccgactttccccccggccccgcacccgcggcgaggtcggaacctcgggaatcgattgaaaacgggccggtcgagataggaccgctctctcgttcggaagcggagcaataaagccgttcggcgtgagctcgggatgagtctcggacgcgcgtcggtccgtttctgcccttgcggcgctctacgaaagaacccgatgaggccgcgttctgttcgggagcggtcccgagctgtagggatcggctcagtagtaactcgtctcgggtttcgatcgagttctagcgaaccccgaaaggggggtacgaggaagcttgcggcctgccgcaaaaagactccgaggagaatagcttatccgcgatacgccgccccctcaaccgttcagcactcacttcggcgtcagttccgaagtgactttgtctggccggctcggcgcgagccggcctcggagagaacgcgtacatagcgatcgtgggctgggcaacgagataggagtagagggatggggaaaaagtgaagtcccgcgctggctctggacgaggcggaacgaaatgggggaggggacggcctctcgaacgagagcgggggtggggcatggtcggtggaggggtgtgggaaacgccgcgacgccgcggcccgtccatgtggtaatgcggggaatagagttccctgacggggaggagttgtcagctcaccggtcccgtgatcaacgcatatgccacatatatgcaaccccgcgaccctctcctcacgaacagggtagagggtctcgctttgttgcacacacaagcacactcacttttgcggcgacaatgaaaatcgtgagcccagaccaattgcccctatatgtgttaacggcctccgacggaacaacggagttcagtattcgagattggtcgctatgggatcgggatccggaatcccgtgcaggtacgcaccgcgggctccgtcaaacggaacgctctcttttggagcgatgtcgtttgggtccgggcccgagtagggttcggccggctatttccctcccccccccccccccaagcccgtgcgggaccgaggttgagtgggaaggtctcgcctgccggatcgggggggaggggaaaagacgtttgcgttatccggaatcgagccggaccgttttacgtttcagagttcgaacacgctctcacgagctgcagccaccggctcaagccctcagaccgcgtccgcgccccgggccagcctagcgtcgcaaacgtctggaagagtctgtggagtttggtttcgagggccgtgcggggaaacgcagagggctcctacggacgaccggaggagggagacgccgaaactgccgtgtaaacgaatgcttagcggagccgcgcccgggacgcgtcgtttcttgcgaaacggggtggatcgctcgcccgctcttagccctcgcgtacagtgcgtcgatcgttaaggtgtacgtgcgtgtacgagaccgcgtgcgagcggtctcgtcgtagtgcgtatgaacgtgtttattaaaaagtctttctcgcttcggtcccgtttcggtgtctggcgatggcgcgggcgggggagtccgtcgcgtaagtcggggaacgtactttgtcctctcctctcccccgaggcgggatgtgcgagggggggggcgacgggcgaccgggaatgcgtgcgattagtgttgtggagaacgtaccgcgccgaggcccgcggtgcgcgcgaagggttagttgggggaggggcacgcgcatcataagtcgctcgcggatcgtccaggtgtttgtgcgggggatacagtttcgcgacggggaggagccgttagctcaccggccccgcgggagacgcagatgcgatataaacagccccgcggtccacctccttgttcgcgacctgctacttagcctcgcttcgttcccacgtataagcaccactgacttacgcggcgaccgtggaagtcgcgagttccgaccagtgtcgcgtatatgtgttaacggcccccgtcggaaccgaattccacattcgagatgaagtgctacggaatcaggaatcccgtcccggccgcgcgcacacccacacacacccccacacacacccccacacacccccacacacaccgcggctacagagcggctgtcgtagtacgtataggcgcgagcgcgaacacttgcacggactctcgtcgtagcacgttcaaatcggtttattaaagccctcatgctcagactccgtgtcgatggcgggggggggggggtggtgagtgacacgaacttactttcctgcgacgctcccgagaggaggtgtgcaccgggccgttttctccgagactgaaaagagaaagaaaagctccgccgttcgcccggccgagcgcccggacgcaccggtgtccgtacggccttcggacgcttagagagcgcgggcgtttcgcgccgctgcggcgtttaggcgcgcagcggcgcgtttgcaaaaaaaaagaatgtacggagagacccgcccgccagcctctccggcccggagcggaaacgccgcgttatctctacgcccccgacccgcacatccgaatgcgcggtcggatcgcgaggttaactccctgcccgcgcccgcgctccgcgctccccctgcgttgtttaccggttcgcgatcgcgatcgcggaagtcgcagggccgacttccttgtttacattgaatacgtcgacggaagcgcaactgcgtatgtccgccgcgcagacgcagaagcgccggggccgaatccgggaagaagagtaatacggggcttctccagcgcgtaagtaccggcgttccgggcggtcggcgagtcggcggagaaaaggtggatcgcgagcgcgatccgaatccgcgggccgaggggaaattcttcctatcccctgtgcgttgagcgccccgtgccgtgccgcctttttccgtttccggtcggactcggagccttcccgccgcacggttcggactcccccccccccccgcaacggttttattttcccgcgttcgaccccggcgtgatgtccgcttttctgttaaaccgtgcgttcgtcttatagggaagccatcttaattctgacatgcgcgaatgcgtctttcccccttccaaggcctaaccccccccgcgctttctcgtttccgccgtgggccatttatcttcccccccgcgtaaacaattatccctcccccgcgcgtcctacttttcttctgagacctatcgcctttggcgattctagtcagattgccttttatagtcaagtttcgagcagatcctaagcaagcatgccctgtaccccaccccccttctaaataaatttccgatccctggaggtttccggagtatttgtcccaggagcggggtcctatgcagtaatcgtaggtctttcatgtatgggggggggggagggggggggagatgcgaacgcccacactggtgttggttcgtccgccacggaagctggaaccccatcggacgtctcggcgccctgtttgcaaaatgtcaggtacttgtagtgcattccacgtaggaaaatggtcgtgaggggagggggggctgagtttttctgttatgggtatcctgaggggtctacgtgaaagtgactggccttccgttttcccacagaaacgttgtgtggtacggtgcaccctgagagatgatctatattctcaggaagttccgtgcccgaaacgctctgaacgataagcttctagattgcatcggggattcctctgagaagagcgggtggggaaatacatagccgttaaagtctcgcggtccgatatccccgtttggccggtggatgagtcgcgatggccggacggggccggaaatgcgatccttcttttgcgggctatttgcgatggaagggaaaggcaaaccggaaaacttaaggccgtttggtgtgtttttcccttccatcgcaggtcgtgccgcagtacttttgaatcggagggagacgtcgggcgagtgggaatgggcatcgcggggtcatcctttattctgggacgaccgcgaatctacgtgtcgtctcagtctggacggcccatggaaaaaaaaaagagtcgagaggcgtggggggggggggaggcctgaacggccggcgcgataagggatacgtggtcaatcttggcgattaagcctagatattgcgcggggagtggggcggcggtccaatgcctagaagggcattattcgaaatttggagtcgggctgcgtagcgacgggtggcgcgcattaatacccctatcttttttttttttgcttcgtttcttgtggccggcttgggaaatgtcagcggaaaacatgcacccgctgtgtgaatgtaaaccgcgtaagtaaacccgtgttagactagatttcgcaagttgcgaaggggggcgattggggaggaggaagtctgaacggaggggggagaagggaggggggagggggaaggctgaacggaggggggagaagggaggggggagggggaaggctgaacggaggtgggagaagggggaagaagggagggagtggggaggggggggggagaagaggggaagggggaaggggggaagggagggggggaagggagggggggaagggagggggggaagggagggggggaagggagggggggaagggagggggaagggaggaagaggggagggggggggaagggaggaagaagggaggggggaagaagggaggggggaagaagggaggggggaagaagggaggggggaagaagggaggggggaagaagggaggggggaagaagggaggggggaagaagggaggggggaagaagggaggggggagaagggagggggggagaagggaggggggaagaagggaggggggagaaggggccctggcgagatcggctctgaattcttcgttgtagatagcagacgaccgtaaacctgaagtacctgtgacttggacggtgatgagatgtttggcctagttacagggactggcctttgttagacacgatggcctttggaaacgcatccagtctgttttggcatctgagtggcgcgtagccgttgtcagatgccagagagactgaaatgtttctcgaggactctaaccgtaatctgaataggcccggaccttaatcccaataggccgtgccgggatatcagaggagagccgctcggaccgctgcgattccatccttcgactagcgacttgttatggcgggtaatagccggacgacggagtctcggcggttcgaccttagcgggccccggataggtttctcggttggggacaaaggggaggtagaggcgtcggatgcggggcgatgagcgggtatttaggccacgagatcaggtgttgtgaggaaggggtaacgacgccgtattgcggtcggaccgcacgacggcgcgtcgtccagtccttcccgggtcccctagaggtgtcacgttctaggacaaccgggacggacagggcgacgcgcgcgaaatgcctcgtatcgcctgatatgctcggaacgagtcggggaagggcgcgaaagcgagagttactactcggaactcgggactgttcgtatgttttctctcaggctggcattgcacgtgtcattgccgttgtgcaatgcctgcggagagaaagacgaattgattccccgtgccgctccccgtcgtgtgggacaaggttgggagggctctgggcgaagaaccggctgagcatcggcgcgcgcgccgtgtcccccctcggcggtgtgcacgggagtatcgggcgccgtcctcatgcccccctccgagggtagcacgcggtggtcgctgcggtcttttcaaaacaggttctgcgaagcagagatgcgtcggcgcgcgagcgaagcgaaccgagctctgctccgtccttagcgtggtgcctgagattttaacacgtatcgtctcaagtactgcgcgcaaggaccgaggcggcgttccaaacgtcggacgggacggcgcggcgtcgtcgcgcgccgcggaaatcgttacacgctccgcttcctccttcgcggggtgcttgagatcaccgaatgacgggatcgagcaccacgccgatggacggagatggcgcgcggtacgttcactgaatcgcaacgaggccgggccgcgctgcagggatggccgcgggtacgcgcgccgagtatgggggggcgcgtgctctcctacggccgactcttgggagcgtgcatcgttcgggggtcggctgttgggtaagacgtggtctctttcaggtcggtgctgttattttcggcggggcgcgggacttcgtcctgggccgtcttacacgcacgtcactctggtcgtatcggtagtcctagtggcttgcttgtaggctgtccgtcggaggaagacagcaccgccgcccagctgcctgtgcgagcgcaggactcgtgtccacgtcctgcgtgactgttcgcccgccgttcggatggtccgtggtacggtgtcctgtgttgtgtgagaggtctccgtacaccggaccatcgaaggggggtgggggggatatgcgaccgcagagcgacttttaggctgccgctgtgcagtgttcggttgggtggggagggaggaatgtctgtaaatcttacggcgatatgctggatcgtgagaggtgagtacgtgtctgtgcgggtaggtgggagcataaccacaaaaagactagaattctgcccgcggggaaatggcggtgtgtgtaatgcttctgttccaaacgaaggtgcggaataggagcgaaatggaccgaccttcccccgcgacgacgtaagtggcttgttacgacctgggaggcctagctgtgttctcgctcgttgccagtggataggctcgcccttttttgtaacagatggcgatggaacagaggttcctatgtgggggggggggggcgggaaggataacgtctatcgatcccgaagtcttcgttgcggatatgagacgatcagtactctcaccgatctgcatatcggacgcggaggggcgagagagggcccgtggttaggcgtctgtactccgaactgcttccattttttcccttacggtgcctgacgtcgtattttaacggttagatgccgtcagggaaagatgggagtttgtttgctcgagccctgccggcggactgcaggcgaagaagtagccgggcgcgaagcggctgggaatcgggtcgcgtggcgtgtcctccttcggacgagtgcttgccggggagtaaccgtcatgcactactccgggggtaggacgcgacgtgcgacgcgctctccggatcggtgccgtgctgcctgagatcgagagcatcggacggagcccagcgccgtcctttgtgctgtgtgtgagaggtcgtcatcccttctcgggcaccgcaccgaaggatggagtgggccctcgaaacgtcatccggaacgccgcgggacgaagccgccccggtaaagtccagacgcgcgcagttccctccttcgtccggtgttcgaggcgtgagacttttgtattgccgcgtcgagcaccgtgctggaggaaggagatggcgctctactccgggacgaaggcgctgcggagcgcatcgcgtggtgttagaggtggatcctgtcatcaagcaccacgtcgatggacggagactgggcgcgaagcgttctgcgggatcgcgtggaacgagggcgcaccctcggtcgcgattttctcgacgcctaccctcggcgttgttcgtcggccgagggtaggcgcagaggaaatcgcggtcgctgtggactccggtgtctggtatcatgtccggctcgagtcgtacgtcctgaaatgttgcttctgattccgacgggtcttcttcacgtacctctctatggctgcatctttatggccatagtgaggtacgtgtaggctacctgccggagaaaggcggtcccgacgaatacgcgtcccgtgtagcggtcgcccgctctgcgatgggctggttccggcatcaatattgcagggtctatttttgtggtgggcgtgaccgcgcatcgcatcgaaataaatctttaaaccggccgagttcattgttgggctatgctcggttttcggggggggggtgtggaaggagggtactaggttagggttagggtcgggcccttagggtcatggtcagggttaggcctttaaggtcatgcttaggtctttaggggcagggtcgggcctttagggtgatggttgggcccttaggggcaggggctcggggtaagggttagtgccagggtcgggtgtcagggtcatggacagggatatgccgttaaggttagggttggggtccaaagttaggcgtttaggggtcgggtcgggttcggggttaggcctttaggggttgtgtctggtttagggttaggcctttaggggcagtctcggggtcgtggttaggcgtttaggggtcgggtcgagttcggggttagacctttaggggtagtgtcgggtttagggttaggcctttaggggtagtgtcgttgtcggggttaggcctgtaggggtagtgtcgttgtcggggttaggcctttaggggtagtgtcggggtcggggttaggcctttaggggcaagctcaggtgcagggtcggggttaggcctttaggggcagggttagggtcagggtcggggttaggcttctggatcgggtctttagggtcggggttaggcttctggatcgggtctttagggtcggggtgattatgatcagagactaagagcgcgaaggcctatcagtgttaggttctctgggtcagggttaaggcctcggggttagggtctcaagggcggcgtttggcttaggggcccggggttaggacctgtcaaggtcagggttatggcctatcagagttcgtggtcacaggtgtaagggttattagggcctattaatgtcaggccctattcgggttaggctcccaccgagtactaaggttagggtcttgtaagggttggggcccgtaagggtaggggctggggtctgttacgggcagggccccccccacacggttcgacctgccacgcttaggttcccatcccccctcccccccccgagtagggttagggcctggcaggggtagggtaggcgcgaaggttgggcccgttagggctaggagcgaccctcctccccccccccattattgttagtctgttaaggaggcgttccccctccccgtcagggttagggcctgttaggggtagggtaacagggttaggttaggggttaaggtctctcggaattagggcggggcgtgtaatggttatagggtcagggcgtgccgcggattgagggtcggggccggcgagggtgtcgttccggtgtttacggaaacggcggatgtgcgcgcatgcgctcgcgcgcgagccagacggacggacggacggacgcgtctcgtagcagcattccatgggcgtttttattcgtactggccgacggcttcagcccgggtcggggctaggagcgcccgcgtgcgcgatgaagccgccgtctcccggcggcgacgcaaaggctgcggtccgcggttcccaagcgtcctgcgtccccgccattgctgcaccgctgccggaaaaagaaaaacatcctgtacgcacttcccgagcgccgggacagaggcggtctccgccagccccccgcgaaattccaaaaagccggtgtggcggactcggccatggaatctacggggggggggttgagggggggatgcggcgctgtagtcgccggatgcagtcaggacacggaaattaagcgcgtccggacgtgccggacaatcgcgtacgcggaagtgcttgcacgggaagtaaacagtggaccgcggcttaccttcccagcaggagtacggtgttcgcggagaaaactgtaaggcgggagcccatcgtcgtgcgctcccggtcctctcggaatcggctgcgagtctcaaaaaaacaggaaaggggatcggcctcacaaaaccacttcctcattcgtgactgcgcgtagcctccgttcttgaaagcggttggcgttcgcacagacctgagtcgacaccgcctacctgttgtttactttcaatgtagtgcgttgcacagagacgctcggggccgggtacaagttgcccgggtccgcgggtctgaagcacgcactcttccgttgaaggacggggtgggaaagcggattattggaccccgcgatagggtctgttagggtcgggggttcggcctgtcatcacggtcggggttagggcctgtcttattcgttttagtgcctgttagggccacattaagggcttgggccagggccgtttacggtggcggttagggcctctcggggtcggcgtcaggactgttagggtcactgttatggcctttcagggttagggtaatagtccatagtcggggtcaggacatattaagggtagcggctttggcggttacggcatgtagggctaggaccttttaatgtaacgggcagcgttggtgtcatgtatcacggtcggggtgactgttaggcctcgccgggcctcatttcacggtcggggctatggcagggtcagagtctgtggtggtgtgcttcggtcacccactgtgtccgcgcaatgctgcgcgttcattctgcctgtagccgacagttcgcggggtgcggcagcccgcgggctgagtgcacctgtggcggcgggaggctgcggcccagccgcgttaattgttgtgctatgttccttttttggggggggggtgaaatgcagggggggatattaagttggttagggttagggttagggttagggttagggttagggttagggttagggttagggttagggttagggttagggttagggttagggttaggccgttagggttagggttaggcctttagggttagggttaggcctttagggttagggttagggtgaattttttttattcagttcgccgccgcgagagttttggtatgacgtttggtggtggccagggtccgccgcgcgcatgctccctacggtccgccgcgcgcatgctccctacggtccgccgcgcgcatgctcgctagggtccgccgcgcgcatgctcgcaaatgtcgactgcgcgcatgcgcgcacgggtccgctacgcatttccgggcggcctagcgagcgcccgcgcggccggcgggcatgtccggcggggatgcagcgtgcggctcggcctactggccgcgcggagccgccggcggtcggcggtctaacgcttggagtcgcgccccccccccccccccgatcagacgcaaggctttttcaggcgcccgtctcggtcacttaggacagccgcggttcgtctcgaaaaaggtctgcggcgtgggtggtgggggaaagggggaggggcagaacagtccagagaccgtcacgggcgaacgattggggtccgcggggggcgcgaggtggactcggtagccgccgcggtccgatccggaaaccgtgtcccccctgcgctttcttcgggcccgctcgccgacgcgaatggggtgggggaggggggtgcgcgggcgaacaattagggaccgcggagtgcgacagcgggcctcggtagccgccgcggtccgatccggaaaccctgtcccgctgccgctttcctcgggcccgctcgccgactcgatcagaaacccgtctcccccgccatttttatgtctcccgtatgcgcgctcgttcccgccactttctggtgccgctgcggaagaggatagccgggcgggcgagcgggcgagcgcgccgcggaccgaaccgctccgcgggctgcgcaggggaccgcagagattgctcccgcgcgagggatcgatccgcggggtagagggctctccgcgaacagcgtaagaacagaggtgtccccgcgcgccgctgcctccggacgcaccccccgcccccccccccccggccacccagggcgaccgaaaccccctgccgccgccggcaagagtcggtcagagagcgcgaatgatgtctgtcgcatctggtcccttcattcattcattcattcattcattcattcattcattcatttatttatttatttattcgccagcgctacatctcaatcccagctaccgttaaccctaccaccacccccccccccccccccgaccttgagcggttctatccgttcgagatgaccttcacggagcggagctcgttgcaggatccggaggagcggtttccgcagccctagggatcgcgattcttcggtacagccgcgcaggccttcggaaaggacgcggcgatctgagtccagggggccacggctccgcgcccgcggtttcggttcccgggcagaccgccgtcggggacccccgggagctttcggagaaggtagggcggagttctgaggcttgagggacaatgagcggcgggtcggttcggttcacgtcgccgtcgggatccggtgcggccccgtccgactttgccgtgggaggctccattgtccgtcccctcccccctttggcggagcgcagggcgaaaggaccccgctttcgccgccgctcctcctcgtacaggccacgggtcttctaggcgctgtcgccgcgcggtcttccttttacgaaactttctctaccgcgtttgcgggagaacactacggcgaacgcgcccgcgggctcgccggcgcttctgcgctactgaatggccgggcgaaggtgcgcgcggggcattcgttctgggaacaggtatagaggcgtggccacggccgaccaatggaccaggcggtgacgcatccgcacggcagaccgcggcccgtacgactaacagcgcggaacgcaaccgagccgcggggttccgctggccccctaatttatttgtccgtctccccgctcgcggatgatatgtcgtacccgcggggctgcttgtccagatagcccttaaaagtccgccgagtgactccccccgcccccccccccccgaccctgacttagccttcactcgccgaagacttcagagtcgctgagggccaagggcgaaggaggaccgggcagcgtcggaggatgaattatcctctgtcgcgcgccctgttcctcctggacggtggtctccggcggaccgccgtccccttccagccacactacagacgagctacgtaggtgagcgagcatctcgcgggccaataaactgcacgtcgcttcgggaacgtgaacgacgactggctgggcgtgcggatcgggggggaggactacggagcggcaaacgtcgcagacggtcctatttaagaaatcgggggaaactatggcgttctttttgggctccaagacgtacacgggacgcagcggggcgtacagtccccacttgagagcggctcggtgggagtgcgactctccagctaaaaagtcggggccgggcggcctctggcgcccggccacaagggccgaggaggctgcgaggtaggagagagcggtcattgggaccgtcgcgacgcggtccagtcgcgtcgcgaccttgtatcggacgttgcttccgcagcacagactgatgtcgccggccgcggggttttcgcggcgaaagtgcgtttccagctcacgtaggaccacggggcccagcacgtcccgcgaggttatgaccgtcgtagctagatcggggtggccaggccatcggacggagcattggctgcggggcgagacggtgcacctgacgtagcggacggcttcttccacgaggcgcgggccgttctccgggcgatcttgatcctctagcgtgtccaggaccacgagccttttttctcgtttcaaacagaggcgttgcaggtgttccaggacgcccgcaaaaccgaggtcctgaggggacaggaacatgacgccggccgcggtcagcgccgaaacgtccggcgccgctctccaccggcccgcccaggcggcgctctccggtaggcagaggcggttggcgagtgcggcgagcaggaaagagagtcctccccggttcgggtcgaaccggggtcccccggggggcgagccgggcgccggtacgcaaaacaggtgctcgcctgggttggccgtgtacaggatgacgagagcgacatcttcaggcgaagcctgctgatgccgcatccaagcggtgcgcgctctgagagagacgacggccgtgcggcacaacactccctcggacgcagcagtgtctgggcttctgctgacgtgcgagggagtgctcgccacgcgagcgatctccgccatggcctccggagaacgcgccaacggctgacgccacagagtcggtatttgggcgaagctggtcagctcgtcgactccttcgcctggacaataggcgtcgaggtgcggggggccggcatagccagcaatcggagttccaatggggggcttcctaaaggcggcgccacgatgccgtcgatcgcctaacgacagggaaccgtccataatgcgcgcggggtcgcgccacggaaagcaacgtgggcgcttgggcgggaaaggcccggcgtcgcggcacgcttcagggggggtggggggccttgtgcagctggcgacaggcggaggtccggcgcctgtccgggaccttcccaaacgcggacgcgggttctcgacggcgttgtccgcgccgtcgagaaccgccgcgggagctgattttctcttccttgactcggctgacgtttgggcgcaaagggcccgcacgggctcgggagaacttgcggggccggggtcgtaacaaggctccgcggagcgcgaccggccctcggacgttccggaagaggccgcgtcggcgtccgcgagaaggcgcgccacgcgttgcagccgtcgggccttctcgcgggatcgtaccggttcgcccctcgacccacattcgcgcaggagcacggaagtaatgtccctcgacccagggcatcgccaaggccgagcggggtctttgctaagcaacgggccgatcgcttccgttatcagggccaccgcattagccgcgagagttcgctcctggcgcccccgaggagccgaaccgttcgcgtaggccgcgtacacggcgctcctgagatcaagcaggtctcggagccacgacccgagcagagcccggcatttttcccactgttcgtggccggcgggtcgagggaagggcccgtcctcgcaagacgacagcatttccgcgaccgcgcccggaccgtcgggtccgcgcagaagcgccgccacgaccccctcgcactccagcgcgcaagcgtccaccagctcgttcagcggccgggtagacgcgaaaccgtccccggcagggatgtccggacgcgcgggcgcgaccaatcggtattcggggacgtccagcaggccctcctctagcgcggaattgaaggccgcgacgccccggcgcacgcggtcgtggatcgtggacacgtctattaccgggatgagcccggccgccgtactttgggcagtgacgggtgcccgatttgaaataggcgatgccgaggggcgtcgcatttcggcgctggctgcagacgccataggcgcgtaggctttcctgagggagcggaacatgaactctttctgatctttgcagtacctgcgagtcatagacacgctggcggcgatgtgcggtagcgcccaaagcagatttcgcttcttcatggcgctggctatgtggggtatgcatttgttgaccgtccccgtgacggccgcgcccggcgaactgtgcgagctctgaaacttcgtgacatagatgtgattgagcgctgcgtcggtgggcgagagcttgccgtggtgtgcccagttcagggggttcgccttcacgtctttgttaagcatggcgcttacgagcgcctcgtactgtttggcgcagttccccatttcctccacgtacaccgggaggggaccgggagtagagaggaatctaacggcggcctgctctacttcagggatgccccggagcgcctgtcggtgtccgccgagaggcccgaaccagcaccggccggccggcggggagggaatttgccaccacacctcttggtcgaggtcatccggcggtggcggcgcagcagtttccgaggacggtgatggcgcccgccggccgcggccgcgccgtcctccgcggccgcggccgcggcctctggcagcgcattgaggcgctcctgcctcgcgggtcggcgacctggatgaggtgcgcgaagaaggggcggcagacgactgttccgatgaagagggcgcggacgacgaagaggacgaggaagaggaagcggacgaggaggaggaagatctggagcgacacccgagcgaagggtacgaggccgggggaggccggggtaggggatgggaagcgcgggtcgccggcgtgccaacctcctgttgtaatgcctgttttagaacagcaggtggagctgttgtgtgcgaaccatcggagcccgatcccggctggactctgcggtaacgttcctgcgtaccggtggggctgctaacgaggcccggcctcggagacggcccgttccagtctggaacgggaagggggggaaacatgggcgctccgtcgtccctcgcgccggacggctgacggaggtgtctgaatcggcgtagcgccgcggcggtgacggcggcgcgccaatcaagtatggctttgtacagaggtctgacccgtttttcgatggccggaccgcaggcggggaaccccagttcgaccatagcgacggcgagctgctgcaccatgaatccgtaggcgcgtgcgggacgagagccgtggggcgtcccgccgggttccggatttccgttccgcagcgccaacttcgattccctgacggccgcggaaagcgcgggagggagcgcggtggcgggcggggggggcatttcgaaaggcacctcgaagccgggccgcacgtcggggccgacgatgtagtcgtctggggccagcagtaacccccgacgcactttgaaaaaaagacacctgtaatgtagcatcttgaaatcgttccaggtgagcccggtccaggggttcgggctgccttcccggccttccacccaccgaatctcctcgagcagaggacagaagttggaggcatagaagccgccgcggcgccggctgcagtcgagaccgcggggggattcagagggcggcgttccgttccagtcctcgtccaagggagtacccgcgcccggcggcggcgcgcacgccggaaagcacggcagaccacgagccgcttgtaattgataggaaaagtcgcgtgtcagaacgtgggccatgtactggacgcgcctgacgcagcggagtcggtccagccagcggtatgaaaggcggggaaccttcgacacgaaatcgggggtgacttgaaggccgaggaagcgaaggagcgccgacaaaatgtaagcgtacgtcggggtgcgcggagccggtctcgggagccgtgttaccgcttcccagatgcgcgttggcagcactatcggggcggggagggggagcgggcactcgttctgcgggccccatccgcaaccctgcgattctaacacgctttccccgtcctcggacggcgacatatcgtccagggtcgagagaacgaggcgcgcgcatcgagaaaacaaccacatcttgcaggccgcccagtcattccccagctcgttcggagggcacgggaagaccggctcctggggcagcgggcgacccttcgcgcaacgccattcgaacggccggtagtcgctgtcgagtaaaggggcctctctcggcagttcgatagaccccggtgaggtccgcagagggctgccgcgcggagtaggtaagatttctctgagtaccgcttccctcgccagccgatcccagtaggaagggcaccggcgagcgtccgacaacgcgaggagaaaaaccttagggttgtctccggaggacggctccgtcgcgccgtcgcgagcccccgcgcgccacaacatagcgtggctccccggctggcgggccaccaactcgagctcttctcgagggggggatgggatcctggcggatgcggataggcggcagacgtactggaagcccgcgcccctggtacgggggcccccgccctcggaaacgctcgatttacggcgggctgggactcggtcgctccggaggggagcgggtgcgaggcggggggctgaaggggacaacggaggggaaggacgctgacaagaagcagagagggctggggggtccggggaaagaggcctgtcgtggagaggggttggcggaggtggggtagacgccggaggcgagtcaagcggtagagacgcagacggggaggatgtctgcgtagagggaggggaggtagacggcagaggcgtggggggaggggaaccgtgcggagggggggtatgcggaggtggcgtaggaggaggggggctaaggggaggtggcgtaggaggaggggggctaagggggggtggcgtaggaggaggggggctaaggggaggtggtgtagggggagtgggtgaatggtgttgagcgaacggtcccggcgtcagcggagaaaatgtccatgggaagttcacgataggttcgggggggggtggggggggcacgcccgagggaggggggagagtttcgacacagacggcgagcggcgtgcaggcgccggtgggcttacagggcgcgtcagatacgcagcggacggggtcgtttgatttgcggggatccatagggctcggttcgccccgttccgaacccgcggggactagatcgccgactgtcttttgccaagaacaggaccgcggggccgccgcggccgtttcgtttccacagacgtccacgatgtccgcggtggaactgacgacctcgccaggagacccctgatgcgcgccgtcggggggttcggcggaacggagacccgtatccgaaccctccgaaacggcaccctcaatgccgaaaggggctcgtgcgccggcaaggctgcccgcgacgggagccgcgcgggcaggggatttagaccgtggcgggacgggctgccgaccgggcgtcgggggcacggccacgctcggtgtattcaagcacacgtcctggtacggatctcccggggtggcgggtggctgcggagaaaatccgccgttgtcggctaacatctctaacaggctgtagaaatcgggcgggttctccatgtccgagcaatgggggaaacgcgcgccggtccaaccgtggcgacgccggcagcactggcgatccgctccttacaggggcgtaaatgcaggggttaatcgggcggatggggaccagcgcagggagcgcggaaggagtcctgctctgaaaaaaatgagggggaaccgtgagaaagcgttccccgcagttcgcatcgcttcttgccccccgcccaacaccaccaccaccccgcccctacacacaccacagccacggctccggcagtgccggcctggctactcctttaatcattaactcccatcaacgcgatttgatccccgggctgctctccgaatcagccgagccccataggtaaacattccgccgcccacaacgtttcttgtcaaacaaacgcttatcggccggattgcgaaacgagcaggttttgccattagatatgctgcggtcagcgctgctaggctccccgggggcaaacattctcctagcgacgccgaggtaaggagacattaaccctcgacacgctcctgcgagcgactgtgcggttcgtgcggtttgtttctctcgctcccgacgttcctaccgccctcgggagagtgctcgcccgggggctagaacccgaagcggaccggcccttgagcatcgagacgcttaggctcgggcgaaccgcccggctctaaaaagtcaagcgcgcgcgtgtatttcttttttttgggggggggggggggggtggtggtggtggttggagacagaagaggagagaaacggagggggtggtggtggttggagacagaagaggagagaaacggagggggtggtggtggttggagacagaagaggagagaaacggagggggcggtggtggttggagacagaagaggagagaaatggagggggtggtggtgggagagaaataccgacggccggacagagcgaattattaagcacccaacgctcacgccaacacgtcccacctctttccccgacccgcgccgccccccccccccccgatattcgcgtcgggggtcagggacaaagagaggcgacggggcaataggcgctgcgtgggggagggggggccggccctacttgcccctaacgcaccggcgtccacgcgatcgcgcgacccgacagcacctaccaggagcgcggtgccggcggcagccccttctcgattcggctcggagctagccgggagagacggccgcggtcacgtctccctttccgaacgcctagcgatatagttacagaccgaagcgagccgtgtcacaccaagtcacttagccgcaattctgttccccttcccccacacacataacaggagacatagcgcatgggaggggctttccttatctctcgagcagaggtcgccgacacgtcaacgaagggcggtacgtgtgtggtaagtagcagagatcggagttggtcccgatttactaacatctaataccgatcgttcatagccgcctggaatttgcgggcataacccgcggataacggtactggtcagggaagcaacgcagcgcagacacgacccgatataaaagactgcaaacgaggttttgtaggggtaatgagatgatgtggaaaagaaatgggtcagggggcgctgtttgttgtgacacatttgcgcctagtgtgggaccggggcgtgcggcgagcacccagcgcggaacgactcgcaagctgacggtgcagggctaactcgcattagaggaagtgtttgctgatttcttcgtagacgctctgcgccgagagcgtctcctcgtttaacctttatgaagaaggaagtcgctcccatctggtgcggaacgatggggtacttctctccgtaatggggaaccgaaaactgaaccaaatacagaaattagaagaggaacatcggcttttcccgttatgtaaaaggaccatggggtcgcgtccgggaggagggggagagtttggggaactcggggccctaagagcgctacaccagactcttcataataccatatgtcaaggcagttgcggtaaatatagcgacgaccgcaaccgaacgggtatttcttctacaggttagaaccatcccatgacccatgcgaaaagtgttacggcacagagaaggccagagggaaactccgcgtccggcaaagcgcacggtaagacactcgcgaggttgtgcaacagcgcatcgccccgggtagaaccgacaggtttatcttcagatggctatcgcggacaactcgtcgtcggggctgggggaggggggggtatgtgtcagccacttccatcctcgtcgctgtcgtcgctcgcaaatgtgggctatcaacgcttctcgattaaaaaaagacaaactagaggggcatccgcaataaacgacaatgtttcatcacaaaacaaatggcgtggtctattctttttcgtttgcctctgatcctgggcggtccgtactgcggggtgatagataaaagaagacaacagcagggaatcgaggtggcgagctcacaaattgcgaagctcagcctatgccggcgatgatggccgatgagggaatgtaggaagagagggcgtatccccgattgacgatggtgcgaccaccaaccgagtccgtgtactcctatcttccattctcacgacaccggacatgagaaacgatgcgcggagcaagtcgggggggggggggggaatgaatccacggcacgcgcagcgcttcctttacattgcaccacgtgaccatattcccataatgacggcaggcgttatctatataatgccaggcagaagtcttacttccgctcgcgatcactattgtcgtcacacggggagtctgactaggcggtatggacggcgtacgagacagagtattacctgatacgtcaacggacaacgagatctaccttgggtcggggtatccggtgcaattacatgatgaatatgggcaaatttctctaggctcgccggtcgaaagcagcaatagcacaggaaatttttgtgctccgccatggatgccggatatccctcgtttaagtaatgatacatgtaagatatttcggtgtctgactagctgtcgtctcaattgcgcaccgttccacgatgctctcagaagagccttgctcgatatgcacatgttaggtcgaatgggattccgtctacgacagcacgaatgggaacgtatcatgcagttgactccagatgagagcattaacctgcggagaactctcctggaagccgacgagcggagcagtcattgtatgccgaacgtgtacgcatctgacattagtaattccctcgaagctggtacaatgcaagttacctccagctccaatatccggggtatcagcaacaagtccgtaaatcactgattacaaaactcactgatgtagacgaacaataaatgtcctattgccagtaatcactttgcctgttatttattgaatgagtatgtcgcgttaattaagtaacgcagtgtgggcgtgacttgtaccatatagatttctattgactacaacgttatccgacctgacatttgggagctgggtgtctatagagacagaaggtgcaccaccgcgcaagataatattgtgatatgtccagtgaggtatgtgaagtaccatcaccgcaaaagcaaatgggcctgtggtcggtgtgccgcaaacttcgcagaacatctcatctgtggccggatcctgcgaatgagaaagtatacggtatactttctgctggtggagtacatatatcatccctgccaaagtctgtacgcggtttggcccgaactgtattgaccgctgccatggtctctttcgcggcaatgaaagctggtatgccgccatccattcacctgtggcgtgagataatggatttaactgacgcaacaatccgccgcgaacaacggtccacatcaaatttctacgtagccggttcgttgaggaaaatagtaagtgttgcattgcgaaattataagcatgcacctgaaacgcatggagaaatggatagccgtctgactgctattatgtattggtgttgtcttgggcatcctggctgctgtattgtttcccatttatatgaggaaaacagtgatctgattaagttgttgggaatggcaacaggctgtggagaaagcccgcttactgaagtagagtcttattggaagcctttatgccgggctgtagcagcgaaggggaatgcattaatttacgacgacgtcgaagtggcacattacctgatcaacgtgcgacaatcgtctgaatcttcgcctccagacgatggggaagacattgagtaaatttgcgcgaatgacagggctcggaaacaatgtatagagttttgcaaataaacactttattgacttaccagaagttattgcatcttattgtaatctgcgtcaatattctctaacttcagttaaaacgtagcaatcgcagaggggcaaactagagaaaaatggacccgcgacctaaatctcgtctaaaacgctccagtgctttacagttcgataatctggacctggggacgcgtataggatcgttcctccacatgcgctgctgtcggtatctcgaatccccggtattcagttgaatcgttggcggagtgtcctcctggactctgcaatgttccctagccgtcttcactatctcgtgcaaggctctataatacagttcctctgcagacccgtcgttgctcttcccttctgcgtcgttagttatttctgtaggctccagacgatttgcctgcatttgtgcgcaacataatctgattgcattccctatctcgtcttccggtaatcccataggtgttcggtattcgcagataggtagagaaagcaccactgcaaatcgtgcaatttccattgccccaaccaatattttttttaagaacggcatcgccgttaatgtacctcgggcattgtgacgatcgaaacccttatggatgcctaaagagagcattgcggtccagttctccaggtgaaaagagaatagcgcgggtagaaacgggccgattagttttatcttcgccgcgtccctaatatcccaagttctgcagtataacttccatcgtccgttttcgacaaggtccggcgcgacatagtttgaaatgtcatctatcagaaacatctcgcccatcgtagaaaaaaacctgtacgcagaccataaaaccattcggtaccacatatccttgtgtatatcaaacgatatgttggttatgtcgttggcggatgttgtatgaaatagagctaagcgttctctggattccacgcactgaacgattccgttagtcaattcatctgctaacataggccaaaagtttattcgtgttacttttctcggcggtttggcaaaacgcccccttggcacatccatgtcattaaatacagcggcataactcctactcatgtgttccatagcccaggtttctgttcggtctgctactacgatcagatcagtggcgcgatcagatgcgtgggatgaatgaagtgtatccgaaagcagttttgagatatacgctaaactgtacgacgattgtggcactaaacgaagctttgcgcgacccccatcccacgcggagtctgtgcaaggttaatgaccctcgcagttcattcggaagttataactgccgccttcgcacatttctttttgtcctgttttgtattgccataacagataggaattgaaacctgatcctcctgttttttgcagcatggccagcaacagaatactttgtcggatcgactacttgcgcgagatggttccgttcttggaggtttcggcgggtcgggtggagaacctattattttatacacacacgtcataccgttgtcgcgaaaatgttctttgtcttctgccgtctcgaacgtcggttcccacgtagacgttaggagcgttggaatggtatcaggaagagcccacggcatgccggaccaagtacccgctactttgaccgcgagcagtctcttcggtaatgggatgtattccagagcagcgcggcagagatcagcggcccccactatccacagactgtatgaagtgttttctgaaacatcggactccaacatcaaatatccagacataacatcttgccattcggaagcacatccgccgacatcttcaaatagcctaactataaacgagtctctagttcctgctaacccagtacctcgaatgccagtcccatccggtgggttcgtcctgataatcggtctctgacgccgaggaagaactaaaaggggtctggaaaagcggaacagatctgcagaccgaacgactacagacacgcccacatcatcatgtatctgttccatgcattgctttatgagaaaaatccataaggccgaggcggcatctctagatctcccggggagtctctcgcactcatctaggagagtgacgacagttatcatagacacgcccatttgtgcaccaaacgaaaagttcctgtactggtggagcgtcggcgcgggaatcggtccgtgctctgaaaccagtgtctagacagaagaccatccggtaaattctggtgtatgaactgacggtctccagacgaacgtcgaagacattaacgatggaaactaacgagctttcttcaaaagtgtctgattacaacgctaatagaccttacgaaactatacgcagcgataccagtgacacagatccgtcggtgtcgtgtgggactctctccgacaaagacggggacgacgaagaatctatagatttaagcaaggtcccgaatgcaacgaatgtcggcgcaggtgaagattgcacatcccccaacgacgggcgcacagagttatgccgtacgacttcggttaccggaccggcctcggtcgtgaggatgcaatacaatattatttcaccattaccgcccagctcggagggccgcgtattcgtctgtacccgttgggacgatgtcagcaataagaaggtgattgttaaagtcgtcaccggaggtagagacccagggagagaaatcgagatcgtaaagacactttcccattgcgcgattatacagctaattcatgcatatagttggaaatctacggtatgtatggtaatgcctaagtataaatgcgatctgtttacctatgtggatagaaaggaatcaatacctttgaaagacgttattgtcattgaacgacgtttgttggaagctctggtttatctgcacggcaaaggtgtaattcatcgcgatgtaaagacagaaaacatatttctggactaccccggaaacgctgttttgggagatttcggggcagcgtgcaaattagacatgcatgataatagtcccaagtgctatggttgggccggaactatggaaacaaattccccagagctcctcgcgctagatccttattgtgccaaaacagatatctggagtgccgggcttgtgttattcgagatgtctgccaaaaaaaggacactgtttggaaaacaagtaaaaacctccagttctcaactgagagcattgattagatgtttgcagatccacgctttagaatttccacaggatgaatccacgactctatgcaaacaattcaaacaatatgcaatcccactgcggcctcctttctccattccagaagttgtaagaagaaatatcccgtcaatggatgttgagtatacaattgcaaaaatgctcacatttgatcaagagtttagaccttcggctcaagacatcctggcgttccccctctttgtgaaagaagccccccaaaatctccaggccctatttgttccctgagtgctaacagcacatgcaatcgaatcccattagaagccgtgctatttaaattttaatgtcgcatagaaatatatggtatacggcgccacgcagagctctatacggcttccactttagaagccaatgttttgtcatcagtgagtaatacgacttgggttacaagagacaaacataatacgtcgaacttaacaaatgccggaatctgtacccgttttctcatcgccgctgctgcatattaacggcaggaagcccttaggtatagcctgagcgtttttacgtccactgcattgccatattcgctacatcacgtatttctacaagaagatgagagtgtctattcaacgggcaattttcctgatatacatatgtacagtctccatgtccagctcggaaaaaactcgtaatgaggacgcctctcgtattagttcttcggacacctttcgcctaaaagaattccccgtatctgcgataccatcgcctctactcgacgtagtcgataactcgtacccgacgaaacacgtcatatacactgacacttgcggtttcgctgttttgaatcccaccggcgatccgaaatacacaatcctcagcttacttttgatgggacgacatagatacgatgctactgttgcatggtacgtcctgggtaagacatgtgctagaccaatttatctacgcgtattttcagattgtcatacaaatgaacaatttgggatgtgcacttcaaaatctccgggatggtgggatattggttatgcaaaaactgcgtatattgaccgtgatgagttgacgttagtattagctgctcctgctccagagttgggtgggctatacacacgtttaatcataattaatggcgagccaatatctagtgacatacttctaacgattgaggggacgtgtagtttttcgctcaaaggcccaatcgacgaccggctctgtaaaccattcaacttttttgtaaatgggaccacgcttgacataggcatgtttcctgcacgaactccccgaccccatgaagaaaacgtaaaacagtggcttacgcgccaaagcggaaaactggatacggttattggtgaagcgtccatgcgtcatgcagcagatttgccacgtgcttttagagattcgtatttgaaatcgcctaaagataacctacctgacgaccctggaaggcctacagtttcaattagcagtatccatgccaatgatgcctatgtaggaagcacctctctgtatgaccaatcgctacgcgcaactgaagagccagtattgccatctgtagatgaggcccgtcctgcgctttatacaaatgcagagaggaaccccaggatgcaactaataatttctgccattgttgttgctagtactgtaatggtcgcactgattgggataagtgcatgtattgttaggaaatgctgtaaaaggaaaatcaaaagagggatacctcaacgcccgtccaggaaagtgtattcccgcctatgattacgtatggacttgggcgtgtcgacacagacacaaaacccagtttgcggccttcttgaaactatcgatgtaatgtctctgtcgaacgggcacatggcacattggagtgcggcgtccaaaaaacatatactatgtttcctatttcttgtcacggggagccattctctaatcttcaccgggacttcgttatccgcatcgacggatcaatcggccatcgttgccttctgtggactcgacaaaacggtgaatgtttacggtagacttttcttcttgggtgactcggttggtgttatttcttacgatggaacgacagaaattctgagatggaacgaaaaactaaagtgtttctcggtcatgtatgccgcgttgtatacggactgcccccttgcagggtctgctttatttagaggatgtagaagcgcggtggtgtatgctacccctcatgacagggtgaagccggtttccgaaaaaggattactgctgtgcatttcagatcccagaatttctgacaccggtacatattacatccgcgtgtccctcgccggcagaaatgtcagtgatattttcagaattgacgtcgttgtgacgagtagcagtattcatacatgcggccatgcggataaaggtatacaggaatgtattaggtatgccgaccgtgtgtcattcgagaactatctaattggacacgtgggacaattgctgcctgtcgactcagagctacacgccgtgtataatgtcactcccagatcggtcgttgggacaaatactgataccatgtcagcttttactaattcgacaacaaaatctgcttcgacgaatttaatcgctatgaagactactcatccaccaagtacgcggcgctgtaacttgaggcgtgcccttccaaaattaatatacatgtcttcattggcaggcctgtgccttctcgtactattaattggtagagcggttgtaaagtgcaaaacgcccaaacccaaaatctacaagggcgactccacctctgacggcatctcgcttatcaattctgcagtaaacgacgcatttgggtgtaatcctgcaaaagaggttgatccctcgaatatttctgaaggcgagaagctggaaaacatgcagaaaacgaccggaaatgtagaaaagtaaccgtgcgagttatgagctggaatggacgttacatgcgggaagaagtagggcgtaactaagtacatgttagaaggggaggggcgggttttgacttttaaaagcacaccgcgggaccacggcggaattatgcttgatatacccgggctacgtggcataatgtcttgtccgcgaatgccccttttcctaatggcggcgatgatgtgcagtgcaaccaccgtaaatcgtatactaattccccaggggaattcggcaacacttaagatctccagatatccgccggttgtagatgggactccatatacagagacgtggacatggatctctaatcgctgcaacgaaacggcgactggatacgtatgtttggacagcgttaattgttttcatgacttaatcgttaaaatggcctgttggcggtattccaaagaggtaatactgcgcactgccagattcgtggtagagaggggcgtgttaaaaacgatagagaccgctaagctgcgcaacgctccgcgtgtattgattgtggacaacgtggacactcaatggactgttttgaatgcgagcgagcaaaacgcgggcatttatattcgatattcccgaaatggaacgagaaccgctcacgtagatgccatagtccttgccgtttctggtcgaaagagaggcagggtgccaccgacagtttatcctgttggaccatttttgcacaaattccaaatctcccttaaaaattttaaaacgttcttatatcaggtgggggataccgttacaatatcgataactacacgcctggagacgacggttcgtgcgttcaagttggagtttcgggtaatgtttctcccctacagtccaaactgtaagtcgttcactatttacgagccgtgtattttccaccccaaagagccagagtgcatatctccgtcggagctatcggaatgtcggtttgcatcaaacgcgcaggtcctggaaattgccgccgcacgctcggtgaactgcagcgcgggccgcgcgtgccattacgatgccgaggtcgacgaatcgatgcagcaaaggttcgcattcctttattcggaaatcccctcgtttacaattggcaatgccgggccgggggacgcgggtctgtacgtcgtcgtcgctctgtgcgatgagcggccgacaacttggactcacgtctatctatcgaccttggacaagatcctagatgtgcacgagatcgctcacaagccgggatttgatgacagagtcttatcgagcaatgacgacgccgctcgcggtgtaagacccggagcggccatcgagaaagaatcaggtaggctccgtctaagcggagccctaattgcatcgatcgtgctggtggccgcggccgtcgtaactacggtaagcttttgcggagcttgcgtcttccggtggcgtcgcaggtgccaccggaagacgcaagctcccggcaactcttgcaagtacatgtcgttgccccaaaatcattgggaagagttttacgacgacgttagggttggcagcgcccctcagtatgagcagtttaaccaaaggttgcccgagagaacgagatcaggctacaccgcttggctctcgtctgatatagccgccgtaagaaagcgtctcgattgaaatcgccgagacgtgcgtgccgattgttgtttttattgtatcgcccgtacttaacggtcctttatccccgcgcgaaataaaactgtccgactcagtctactggtgctcgcgtttacctccactgcgtaccgcgcgccaattttcgtgtaggtgtgcgtatggtggagtggtttgggggaccctgtctctaagccggcacactccacgctatttccccccgcccggtgggcacaagcgcttgcgggaggaaccagttgtcggttttttatgcgggctcctcagcaccttcgccacccacccacactccgcgccccgactgcgcgaagctgccccgtttaggcaaacggggcccggccggcgcgacgcagaagaataaagcagactccgtcgtttcttctataatggagggtatactcgtttattgcgacatcacaccccgtgttgctattttaaattgaaggccgttgataacccgcatcatccactaacgtcgttagcgataacgattgtatcttcccccccccccccacctacggtttgtcgacagctatgataagcggaggaaaacctgcctgattccttgggcggggatccttgtgcgctgtcttgctctgtatgcgccgacccaaagccgcctcctcctcaacgtaaatttaaccgcccaggccgcgtagttgcgtgtcctgaacgggaaagaagttcgttcgctgttattgtggtcattaccgtaactgtcccggcgtgcctccatctgctgagtcccgtgcagactggcatgaggatggttgttcggcggcaggcaactcccccctcatccctactaatcccgaatgcctttaatgatcacgcaataacccctcctcttaacaatatctctttttcgatgaagatttcagttcccccataacacggcagaacgagtctgatccctgatcaattggaacgacttccttcttcagaaaggttaaacgaggacacagtctgcgacgagagggcttaacacttcctcctgtgcgagagcgcgtctctgcgatgtggcttcgccgcaaagtcctttcccatactaggcgtaaaccgcactataacaactccccctccccccagcacccaaggggcccgtgaaaccgcgactggtttcttcttcactggctcagtactgcaaatgtgctgcttacctcgtgattgctgtcgtcggggctcgttcgcactttccaggccaccaaagaaagcgagaccagagccaatcgggaccatctccgaaccttgttcgctaccacacacgtgccgccctttgttgacgtggccgcaaacagagctcgtggccacgccaacgaactgctcgtcctataaaacccctcccatactcaatgccccctgaaatgtttgcaggggggaaagtgaagccttctgcttcattcaggtgttcgcaatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacaggaaagggagacgtgaccgcggccgtctctcccggctagctccgagccgaatcgagaaggggctgccgccggcaccgcgctcctggtaggtgctgtcgggtcgcgcgatcgcgtggacgccggtgcgttaggggcaagtagggccggccccccctcccccacgcagcgcctattgccccgtcgcctctctttgtccctgaccccgacgcgaatatcggggggggggggggcggcgcgggtcggggaaagaggtgggacgtgttggcgtgagcgttgggtgcttaataattcgctctgtccggccgtcggtatttctctcccaccaccaccccctccatttctctcctcttctgtctccaaccaccaccgccccctccgtttctctcctcttctgtctccaaccaccaccaccccctccgtttctctcctcttctgtctccaaccaccaccaccccctccgtttctctcctcttctgtctccaaccaccaccaccacccccccccccccccccaaaaaaaagaaatacacgcgcgcgcttgactttttagagccgggcggttcgcccgagcctaagcgtctcgatgctcaagggccggtccgcttcgggttctagcccccgggcgagcactctcccgagggcggtaggaacgtcgggagcgagagaaacaaaccgcacgaaccgcacagtcgctcgcaggagcgtgtcgagggttaatgtctccttacctcggcgtcgctaggagaatgtttgcccccggggagcctagcagcgctgaccgcagcatatctaatggcaaaacctgctcgtttcgcaatccggccgataagcgtttgtttgacaagaaacgttgtgggcggcggaatgtttacctatggggctcggctgattcggagagcagcccggggatcaaatcgcgttgatgggagttaatgattaaaggagtagccaggccggcactgccggagccgtggctgtggtgtgtgtaggggcggggtggtggtggtgttgggcggggggcaagaagcgatgcgaactgcggggaacgctttctcacggttccccctcatttttttcagagcaggactccttccgcgctccctgcgctggtccccatccgcccgattaacccctgcatttacgcccctgtaaggagcggatcgccagtgctgccggcgtcgccacggttggaccggcgcgcgtttcccccattgctcggacatggagaacccgcccgatttctacagcctgttagagatgttagccgacaacggcggattttctccgcagccacccgccaccccgggagatccgtaccaggacgtgtgcttgaatacaccgagcgtggccgtgcccccgacgcccggtcggcagcccgtcccgccacggtctaaatcccctgcccgcgcggctcccgtcgcgggcagccttgccggcgcacgagcccctttcggcattgagggtgccgtttcggagggttcggatacgggtctccgttccgccgaaccccccgacggcgcgcatcaggggtctcctggcgaggtcgtcagttccaccgcggacatcgtggacgtctgtggaaacgaaacggccgcggcggccccgcggtcctgttcttggcaaaagacagtcggcgatctagtccccgcgggttcggaacggggcgaaccgagccctatggatccccgcaaatcaaacgaccccgtccgctgcgtatctgacgcgccctgtaagcccaccggcgcctgcacgccgctcgccgtctgtgtcgaaactctcccccctccctcgggcgtgccccccccacccccccccgaacctatcgtgaacttcccatggacattttctccgctgacgccgggaccgttcgctcaacaccattcacccactccccctacaccacctccccttagcccccctcctcctacgccacccccccttagcccccctcctcctacgccacctccccttagcccccctcctcctacgccacctccgcataccccccctccgcacggttcccctccccccacgcctctgccgtctacctcccctccctctacgcagacatcctccccgtctgcgtctctaccgcttgactcgcctccggcgtctaccccacctccgccaacccctctccacgacaggcctctttccccggaccccccagccctctctgcttcttgtcagcgtccttcccctccgttgtccccttcagccccccgcctcgcacccgctcccctccggagcgaccgagtcccagcccgccgtaaatcgagcgtttccgagggcgggggcccccgtaccaggggcgcgggcttccagtacgtctgccgcctatccgcatccgccaggatcccatccccccctcgagaagagctcgagttggtggcccgccagccggggagccacgctatgttgtggcgcgcgggggctcgcgacggcgcgacggagccgtcctccggagacaaccctaaggtttttctcctcgcgttgtcggacgctcgccggtgcccttcctactgggatcggctggcgagggaagcggtactcagagaaatcttacctactccgcgcggcagccctctgcggacctcaccggggtctatcgaactgccgagagaggcccctttactcgacagcgactaccggccgttcgaatggcgttgcgcgaagggtcgcccgctgccccaggagccggtcttcccgtgccctccgaacgagctggggaatgactgggcggcctgcaagatgtggttgttttctcgatgcgcgcgcctcgttctctcgaccctggacgatatgtcgccgtccgaggacggggaaagcgtgttagaatcgcagggttgcggatggggcccgcagaacgagtgcccgctccccctccccgccccgatagtgctgccaacgcgcatctgggaagcggtaacacggctcccgagaccggctccgcgcaccccgacgtacgcttacattttgtcggcgctccttcgcttcctcggccttcaagtcacccccgatttcgtgtcgaaggttccccgcctttcataccgctggctggaccgactccgctgcgtcaggcgcgtccagtacatggcccacgttctgacacgcgacttttcctatcaattacaagcggctcgtggtctgccgtgctttccggcgtgcgcgccgccgccgggcgcgggtactcccttggacgaggactggaacggaacgccgccctctgaatccccccgcggtctcgactgcagccggcgccgcggcggcttctatgcctccaacttctgtcctctgctcgaggagattcggtgggtggaaggccgggaaggcagcccgaacccctggaccgggctcacctggaacgatttcaagatgctacattacaggtgtctttttttcaaagtgcgtcgggggttactgctggccccagacgactacatcgtcggccccgacgtgcggcccggcttcgaggtgcctttcgaaatgccccccccgcccgccaccgcgctccctcccgcgctttccgcggccgtcagggaatcgaagttggcgctgcggaacggaaatccggaacccggcgggacgccccacggctctcgtcccgcacgcgcctacggattcatggtgcagcagctcgccgtcgctatggtcgaactggggttccccgcctgcggtccggccatcgaaaaacgggtcagacctctgtacaaagccatacttgattggcgcgccgccgtcaccgccgcggcgctacgccgattcagacacctccgtcagccgtccggcgcgagggacgacggagcgcccatgtttcccccccttcccgttccagactggaacgggccgtctccgaggccgggcctcgttagcagccccaccggtacgcaggaacgttaccgcagagtccagccgggatcgggctccgatggttcgcacacaacagctccacctgctgttctaaaacaggcattacaacaggaggttggcacgccggcgacccgcgcttcccatcccctaccccggcctcccccggcctcgtacccttcgctcgggtgtcgctccagatcttcctcctcctcgtccgcttcctcttcctcgtcctcttcgtcgtccgcgccctcttcatcggaacagtcgtctgccgccccttcttcgcgcacctcatccaggtcgccgacccgcgaggcaggagcgcctcaatgcgctgccagaggccgcggccgcggccgcggaggacggcgcggccgcggccggcgggcgccatcaccgtcctcggaaactgctgcgccgccaccgccggatgacctcgaccaagaggtgtggtggcaaattccctccccgccggccggccggtgctggttcgggcctctcggcggacaccgacaggcgctccggggcatccctgaagtagagcaggccgccgttagattcctctctactcccggtcccctcccggtgtacgtggaggaaatggggaactgcgccaaacagtacgaggcgctcgtaagcgccatgcttaacaaagacgtgaaggcgaaccccctgaactgggcacaccacggcaagctctcgcccaccgacgcagcgctcaatcacatctatgtcacgaagtttcagagctcgcacagttcgccgggcgcggccgtcacggggacggtcaacaaatgcataccccacatagccagcgccatgaagaagcgaaatctgctttgggcgctaccgcacatcgccgccagcgtgtctatgactcgcaggtactgcaaagatcagaaagagttcatgttccgctccctcaggaaagcctacgcgcctatggcgtctgcagccagcgccgaaatgcgacgcccctcggcatcgcctatttcaaatcgggcacccgtcactgcccaaagtacggcggccgggctcatcccggtaatagacgtgtccacgatccacgaccgcgtgcgccggggcgtcgcggccttcaattccgcgctagaggagggcctgctggacgtccccgaataccgattggtcgcgcccgcgcgtccggacatccctgccggggacggtttcgcgtctacccggccgctgaacgagctggtggacgcttgcgcgctggagtgcgagggggtcgtggcggcgcttctgcgcggacccgacggtccgggcgcggtcgcggaaatgctgtcgtcttgcgaggacgggcccttccctcgacccgccggccacgaacagtgggaaaaatgccgggctctgctcgggtcgtggctccgagacctgcttgatctcaggagcgccgtgtacgcggcctacgcgaacggttcggctcctcgggggcgccaggagcgaactctcgcggctaatgcggtggccctgataacggaagcgatcggcccgttgcttagcaaagaccccgctcggccttggcgatgccctgggtcgagggacattacttccgtgctcctgcgcgaatgtgggtcgaggggcgaaccggtacgatcccgcgagaaggcccgacggctgcaacgcgtggcgcgccttctcgcggacgccgacgcggcctcttccggaacgtccgagggccggtcgcgctccgcggagccttgttacgaccccggccccgcaagttctcccgagcccgtgcgggccctttgcgcccaaacgtcagccgagtcaaggaagagaaaatcagctcccgcggcggttctcgacggcgcggacaacgccgtcgagaacccgcgtccgcgtttgggaaggtcccggacaggcgccggacctccgcctgtcgccagctgcacaaggccccccaccccccctgaagcgtgccgcgacgccgggcctttcccgcccaagcgcccacgttgctttccgtggcgcgaccccgcgcgcattatggacggttccctgtcgttaggcgatcgacggcatcgtggcgccgcctttaggaagccccccattggaactccgattgctggctatgccggccccccgcacctcgacgcctattgtccaggcgaaggagtcgacgagctgaccagcttcgcccaaataccgactctgtggcgtcagccgttggcgcgttctccggaggccatggcggagatcgctcgcgtggcgagcactccctcgcacgtcagcagaagcccagacactgctgcgtccgagggagtgttgtgccgcacggccgtcgtctctctcagagcgcgcaccgcttggatgcggcatcagcaggcttcgcctgaagatgtcgctctcgtcatcctgtacacggccaacccaggcgagcacctgttttgcgtaccggcgcccggctcgccccccgggggaccccggttcgacccgaaccggggaggactctctttcctgctcgccgcactcgccaaccgcctctgcctaccggagagcgccgcctgggcgggccggtggagagcggcgccggacgtttcggcgctgaccgcggccggcgtcatgttcctgtcccctcaggacctcggttttgcgggcgtcctggaacacctgcaacgcctctgtttgaaacgagaaaaaaggctcgtggtcctggacacgctagaggatcaagatcgcccggagaacggcccgcgcctcgtggaagaagccgtccgctacgtcaggtgcaccgtctcgccccgcagccaatgctccgtccgatggcctggccaccccgatctagctacgacggtcataacctcgcgggacgtgctgggccccgtggtcctacgtgagctggaaacgcactttcgccgcgaaaaccccgcggccggcgacatcagtctgtgctgcggaagcaacgtccgatacaaggtcgcgacgcgactggaccgcgtcgcgacggtcccaatgaccgctctctcctacctcgcagcctcctcggcccttgtggccgggcgccagaggccgcccggccccgactttttagctggagagtcgcactcccaccgagccgctctcaagtggggactgtacgccccgctgcgtcccgtgtacgtcttggagcccaaaaagaacgccatagtttcccccgatttcttaaataggaccgtctgcgacgtttgccgctccgtagtcctcccccccgatccgcacgcccagccagtcgtcgttcacgttcccgaagcgacgtgcagtttattggcccgcgagatgctcgctcacctacgtagctcgtctgtagtgtggctggaaggggacggcggtccgccggagaccaccgtccaggaggaacagggcgcgcgacagaggataattcatcctccgacgctgcccggtcctccttcgcccttggccctcagcgactctgaagtcttcggcgagtgaaggctaagtcagggtcgggggggggggggcggggggagtcactcggcggacttttaagggctatctggacaagcagccccgcgggtacgacatatcatccgcgagcggggagacggacaaataaattagggggccagcggaaccccgcggctcggttgcgttccgcgctgttagtcgtacgggccgcggtctgccgtgcggatgcgtcaccgcctggtccattggtcggccgtggccacgcctctatacctgttcccagaacgaatgccccgcgcgcaccttcgcccggccattcagtagcgcagaagcgccggcgagcccgcgggcgcgttcgccgtagtgttctcccgcaaacgcggtagagaaagtttcgtaaaaggaagaccgcgcggcgacagcgcctagaagacccgtggcctgtacgaggaggagcggcggcgaaagcggggtcctttcgccctgcgctccgccaaaggggggaggggacggacaatggagcctcccacggcaaagtcggacggggccgcaccggatcccgacggcgacgtgaaccgaaccgacccgccgctcattgtccctcaagcctcagaactccgccctaccttctccgaaagctcccgggggtccccgacggcggtctgcccgggaaccgaaaccgcgggcgcggagccgtggccccctggactcagatcgccgcgtcctttccgaaggcctgcgcggctgtaccgaagaatcgcgatccctagggctgcggaaaccgctcctccggatcctgcaacgagctccgctccgtgaaggtcatctcgaacggatagaaccgctcaaggtcgggggggggggggggggtggtggtagggttaacggtagctgggattgagatgtagcgctggcgaataaataaataaataaatgaatgaatgaatgaatgaatgaatgaatgaatgaatgaagggaccagatgcgacagacatcattcgcgctctctgaccgactcttgccggcggcggcagggggtttcggtcgccctgggtggccgggggggggggggcggggggtgcgtccggaggcagcggcgcgcggggacacctctgttcttacgctgttcgcggagagccctctaccccgcggatcgatccctcgcgcgggagcaatctctgcggtcccctgcgcagcccgcggagcggttcggtccgcggcgcgctcgcccgctcgcccgcccggctatcctcttccgcagcggcaccagaaagtggcgggaacgagcgcgcatacgggagacataaaaatggcgggggagacgggtttctgatcgagtcggcgagcgggcccgaggaaagcggcagcgggacagggtttccggatcggaccgcggcggctaccgaggcccgctgtcgcactccgcggtccctaattgttcgcccgcgcacccccctcccccaccccattcgcgtcggcgagcgggcccgaagaaagcgcaggggggacacggtttccggatcggaccgcggcggctaccgagtccacctcgcgccccccgcggaccccaatcgttcgcccgtgacggtctctggactgttctgcccctccccctttcccccaccacccacgccgcagacctttttcgagacgaaccgcggctgtcctaagtgaccgagacgggcgcctgaaaaagccttgcgtctgatcggggggggggggggggcgcgactccaagcgttagaccgccgaccgccggcggctccgcgcggccagtaggccgagccgcacgctgcatccccgccggacatgcccgccggccgcgcgggcgctcgctaggccgcccggaaatgcgtagcggacccgtgcgcgcatgcgcgcagtcgacatttgcgagcatgcgcgcggcggaccctagcgagcatgcgcgcggcggaccgtagggagcatgcgcgcggcggaccgtagggagcatgcgcgcggcggaccctggccaccaccaaacgtcataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggct

SEQ ID NO: 5 - DNA, 169390 bp, unidentified
  source 1..169390: mol_type = other DNA; note = Genoma completo del virus rSB1-F
ataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggctgggccgcagcctcccgccgccacaggtgcactcagcccgcgggctgccgcaccccgcgaactgtcggctacaggcagaatgaacgcgcagcattgcgcggacacagtgggtgaccgaagcacaccaccacagactctgaccctgccatagccccgaccgtgaaatgaggcccggcgaggcctaacagtcaccccgaccgtgatacatgacaccaacgctgcccgttacattaaaaggtcctagccctacatgccgtaaccgccaaagccgctacccttaatatgtcctgaccccgactatggactattaccctaaccctgaaaggccataacagtgaccctaacagtcctgacgccgaccccgagaggccctaaccgccaccgtaaacggccctggcccaagcccttaatgtggccctaacaggcactaaaacgaataagacaggccctaaccccgaccgtgatgacaggccgaacccccgaccctaacagaccctatcgcggggtccaataatccgctttcccaccccgtccttcaacggaagagtgcgtgcttcagacccgcggacccgggcaacttgtacccggccccgagcgtctctgtgcaacgcactacattgaaagtaaacaacaggtaggcggtgtcgactcaggtctgtgcgaacgccaaccgctttcaagaacggaggctacgcgcagtcacgaatgaggaagtggttttgtgaggccgatcccctttcctgtttttttgagactcgcagccgattccgagaggaccgggagcgcacgacgatgggctcccgccttacagttttctccgcgaacaccgtactcctgctgggaaggtaagccgcggtccactgtttacttcccgtgcaagcacttccgcgtacgcgattgtccggcacgtccggacgcgcttaatttccgtgtcctgactgcatccggcgactacagcgccgcatccccccctcaaccccccccccgtagattccatggccgagtccgccacaccggctttttggaatttcgcggggggctggcggagaccgcctctgtcccggcgctcgggaagtgcgtacaggatgtttttctttttccggcagcggtgcagcaatggcggggacgcaggacgcttgggaaccgcggaccgcagcctttgcgtcgccgccgggagacggcggcttcatcgcgcacgcgggcgctcctagccccgacccgggctgaagccgtcggccagtacgaataaaaacgcccatggaatgctgctacgagacgcgtccgtccgtccgtccgtctggctcgcgcgcgagcgcatgcgcgcacatccgccgtttccgtaaacaccggaacgacaccctcgccggccccgaccctcaatccgcggcacgccctgaccctataaccattacacgccccgccctaattccgagagaccttaacccctaacctaaccctgttaccctacccctaacaggccctaaccctgacggggagggggaacgcctccttaacagactaacaataatggggggggggaggagggtcgctcctagccctaacgggcccaaccttcgcgcctaccctacccctgccaggccctaaccctactcgggggggggaggggggatgggaacctaagcgtggcaggtcgaaccgtgtggggggggccctgcccgtaacagaccccagcccctacccttacgggccccaacccttacaagaccctaaccttagtactcggtgggagcctaacccgaatagggcctgacattaataggccctaataacccttacacctgtgaccacgaactctgataggccataaccctgaccttgacaggtcctaaccccgggcccctaagccaaacgccgcccttgagaccctaaccccgaggccttaaccctgacccagagaacctaacactgataggccttcgcgctcttagtctctgatcataatcaccccgaccctaaagacccgatccagaagcctaaccccgaccctaaagacccgatccagaagcctaaccccgaccctgaccctaaccctgcccctaaaggcctaaccccgaccctgcacctgagcttgcccctaaaggcctaaccccgaccccgacactacccctaaaggcctaaccccgacaacgacactacccctacaggcctaaccccgacaacgacactacccctaaaggcctaaccctaaacccgacactacccctaaaggtctaaccccgaactcgacccgacccctaaacgcctaaccacgaccccgagactgcccctaaaggcctaaccctaaaccagacacaacccctaaaggcctaaccccgaacccgacccgacccctaaacgcctaactttggaccccaaccctaaccttaacggcatatccctgtccatgaccctgacacccgaccctggcactaacccttaccccgagcccctgcccctaagggcccaaccatcaccctaaaggcccgaccctgcccctaaagacctaagcatgaccttaaaggcctaaccctgaccatgaccctaagggcccgaccctaaccctaacctagtaccctccttccacaccccccccccgaaaaccgagcatagcccaacaatgaactcggccggtttaaagatttatttcgatgcgatgcgcggtcacgcccaccacaaaaatagaccctgcaatattgatgccggaaccagcccatcgcagagcgggcgaccgctacacgggacgcgtattcgtcgggaccgcctttctccggcaggtagcctacacgtacctcactatggccataaagatgcagccatagagaggtacgtgaagaagacccgtcggaatcagaagcaacatttcaggacgtacgactcgagccggacatgataccagacaccggagtccacagcgaccgcgatttcctctgcgcctaccctcggccgacgaacaacgccgagggtaggcgtcgagaaaatcgcgaccgagggtgcgccctcgttccacgcgatcccgcagaacgcttcgcgcccagtctccgtccatcgacgtggtgcttgatgacaggatccacctctaacaccacgcgatgcgctccgcagcgccttcgtcccggagtagagcgccatctccttcctccagcacggtgctcgacgcggcaatacaaaagtctcacgcctcgaacaccggacgaaggagggaactgcgcgcgtctggactttaccggggcggcttcgtcccgcggcgttccggatgacgtttcgagggcccactccatccttcggtgcggtgcccgagaagggatgacgacctctcacacacagcacaaaggacggcgctgggctccgtccgatgctctcgatctcaggcagcacggcaccgatccggagagcgcgtcgcacgtcgcgtcctacccccggagtagtgcatgacggttactccccggcaagcactcgtccgaaggaggacacgccacgcgacccgattcccagccgcttcgcgcccggctacttcttcgcctgcagtccgccggcagggctcgagcaaacaaactcccatctttccctgacggcatctaaccgttaaaatacgacgtcaggcaccgtaagggaaaaaatggaagcagttcggagtacagacgcctaaccacgggccctctctcgcccctccgcgtccgatatgcagatcggtgagagtactgatcgtctcatatccgcaacgaagacttcgggatcgatagacgttatccttcccgcccccccccccccacataggaacctctgttccatcgccatctgttacaaaaaagggcgagcctatccactggcaacgagcgagaacacagctaggcctcccaggtcgtaacaagccacttacgtcgtcgcgggggaaggtcggtccatttcgctcctattccgcaccttcgtttggaacagaagcattacacacaccgccatttccccgcgggcagaattctagtctttttgtggttatgctcccacctacccgcacagacacgtactcacctctcacgatccagcatatcgccgtaagatttacagacattcctccctccccacccaaccgaacactgcacagcggcagcctaaaagtcgctctgcggtcgcatatcccccccaccccccttcgatggtccggtgtacggagacctctcacacaacacaggacaccgtaccacggaccatccgaacggcgggcgaacagtcacgcaggacgtggacacgagtcctgcgctcgcacaggcagctgggcggcggtgctgtcttcctccgacggacagcctacaagcaagccactaggactaccgatacgaccagagtgacgtgcgtgtaagacggcccaggacgaagtcccgcgccccgccgaaaataacagcaccgacctgaaagagaccacgtcttacccaacagccgacccccgaacgatgcacgctcccaagagtcggccgtaggagagcacgcgcccccccatactcggcgcgcgtacccgcggccatccctgcagcgcggcccggcctcgttgcgattcagtgaacgtaccgcgcgccatctccgtccatcggcgtggtgctcgatcccgtcattcggtgatctcaagcaccccgcgaaggaggaagcggagcgtgtaacgatttccgcggcgcgcgacgacgccgcgccgtcccgtccgacgtttggaacgccgcctcggtccttgcgcgcagtacttgagacgatacgtgttaaaatctcaggcaccacgctaaggacggagcagagctcggttcgcttcgctcgcgcgccgacgcatctctgcttcgcagaacctgttttgaaaagaccgcagcgaccaccgcgtgctaccctcggaggggggcatgaggacggcgcccgatactcccgtgcacaccgccgaggggggacacggcgcgcgcgccgatgctcagccggttcttcgcccagagccctcccaaccttgtcccacacgacggggagcggcacggggaatcaattcgtctttctctccgcaggcattgcacaacggcaatgacacgtgcaatgccagcctgagagaaaacatacgaacagtcccgagttccgagtagtaactctcgctttcgcgcccttccccgactcgttccgagcatatcaggcgatacgaggcatttcgcgcgcgtcgccctgtccgtcccggttgtcctagaacgtgacacctctaggggacccgggaaggactggacgacgcgccgtcgtgcggtccgaccgcaatacggcgtcgttaccccttcctcacaacacctgatctcgtggcctaaatacccgctcatcgccccgcatccgacgcctctacctcccctttgtccccaaccgagaaacctatccggggcccgctaaggtcgaaccgccgagactccgtcgtccggctattacccgccataacaagtcgctagtcgaaggatggaatcgcagcggtccgagcggctctcctctgatatcccggcacggcctattgggattaaggtccgggcctattcagattacggttagagtcctcgagaaacatttcagtctctctggcatctgacaacggctacgcgccactcagatgccaaaacagactggatgcgtttccaaaggccatcgtgtctaacaaaggccagtccctgtaactaggccaaacatctcatcaccgtccaagtcacaggtacttcaggtttacggtcgtctgctatctacaacgaagaattcagagccgatctcgccagggccccttctcccccctcccttcttcccccctcccttctccccccctcccttctcccccctcccttcttcccccctcccttcttcccccctcccttcttcccccctcccttcttcccccctcccttcttcccccctcccttcttcccccctcccttcttcccccctcccttcttcccccctcccttcttcctcccttccccccccctcccctcttcctcccttccccctcccttccccccctcccttccccccctcccttccccccctcccttccccccctcccttccccccctcccttccccccttcccccttcccctcttctcccccccccctccccactccctcccttcttcccccttctcccacctccgttcagccttccccctcccccctcccttctcccccctccgttcagccttccccctcccccctcccttctcccccctccgttcagacttcctcctccccaatcgccccccttcgcaacttgcgaaatctagtctaacacgggtttacttacgcggtttacattcacacagcgggtgcatgttttccgctgacatttcccaagccggccacaagaaacgaagcaaaaaaaaaaaagataggggtattaatgcgcgccacccgtcgctacgcagcccgactccaaatttcgaataatgcccttctaggcattggaccgccgccccactccccgcgcaatatctaggcttaatcgccaagattgaccacgtatcccttatcgcgccggccgttcaggccctccccccccccccacgcctctcgactcttttttttttccatgggccgtccagactgagacgacacgtagattcgcggtcgtcccagaataaaggatgaccccgcgatgcccattcccactcgcccgacgtctccctccgattcaaaagtactgcggcacgacctgcgatggaagggaaaaacacaccaaacggccttaagttttccggtttgcctttcccttccatcgcaaatagcccgcaaaagaaggatcgcatttccggccccgtccggccatcgcgactcatccaccggccaaacggggatatcggaccgcgagactttaacggctatgtatttccccacccgctcttctcagaggaatccccgatgcaatctagaagcttatcgttcagagcgtttcgggcacggaacttcctgagaatatagatcatctctcagggtgcaccgtaccacacaacgtttctgtgggaaaacggaaggccagtcactttcacgtagacccctcaggatacccataacagaaaaactcagccccccctcccctcacgaccattttcctacgtggaatgcactacaagtacctgacattttgcaaacagggcgccgagacgtccgatggggttccagcttccgtggcggacgaaccaacaccagtgtgggcgttcgcatctccccccccctcccccccccccatacatgaaagacctacgattactgcataggaccccgctcctgggacaaatactccggaaacctccagggatcggaaatttatttagaaggggggtggggtacagggcatgcttgcttaggatctgctcgaaacttgactataaaaggcaatctgactagaatcgccaaaggcgataggtctcagaagaaaagtaggacgcgcgggggagggataattgtttacgcgggggggaagataaatggcccacggcggaaacgagaaagcgcgggggggggttaggccttggaagggggaaagacgcattcgcgcatgtcagaattaagatggcttccctataagacgaacgcacggtttaacagaaaagcggacatcacgccggggtcgaacgcgggaaaataaaaccgttgcgggggggggggggagtccgaaccgtgcggcgggaaggctccgagtccgaccggaaacggaaaaaggcggcacggcacggggcgctcaacgcacaggggataggaagaatttcccctcggcccgcggattcggatcgcgctcgcgatccaccttttctccgccgactcgccgaccgcccggaacgccggtacttacgcgctggagaagccccgtattactcttcttcccggattcggccccggcgcttctgcgtctgcgcggcggacatacgcagttgcgcttccgtcgacgtattcaatgtaaacaaggaagtcggccctgcgacttccgcgatcgcgatcgcgaaccggtaaacaacgcagggggagcgcggagcgcgggcgcgggcagggagttaacctcgcgatccgaccgcgcattcggatgtgcgggtcgggggcgtagagataacgcggcgtttccgctccgggccggagaggctggcgggcgggtctctccgtacattctttttttttgcaaacgcgccgctgcgcgcctaaacgccgcagcggcgcgaaacgcccgcgctctctaagcgtccgaaggccgtacggacaccggtgcgtccgggcgctcggccgggcgaacggcggagcttttctttctcttttcagtctcggagaaaacggcccggtgcacacctcctctcgggagcgtcgcaggaaagtaagttcgtgtcactcaccacccccccccccccgccatcgacacggagtctgagcatgagggctttaataaaccgatttgaacgtgctacgacgagagtccgtgcaagtgttcgcgctcgcgcctatacgtactacgacagccgctctgtagccgcggtgtgtgtgggggtgtgtgggggtgtgtgtgggggtgtgtgtgggtgtgcgcgcggccgggacgggattcctgattccgtagcacttcatctcgaatgtggaattcggttccgacgggggccgttaacacatatacgcgacactggtcggaactcgcgacttccacggtcgccgcgtaagtcagtggtgcttatacgtgggaacgaagcgaggctaagtagcaggtcgcgaacaaggaggtggaccgcggggctgtttatatcgcatctgcgtctcccgcggggccggtgagctaacggctcctccccgtcgcgaaactgtatcccccgcacaaacacctggacgatccgcgagcgacttatgatgcgcgtgcccctcccccaactaacccttcgcgcgcaccgcgggcctcggcgcggtacgttctccacaacactaatcgcacgcattcccggtcgcccgtcgccccccccctcgcacatcccgcctcgggggagaggagaggacaaagtacgttccccgacttacgcgacggactcccccgcccgcgccatcgccagacaccgaaacgggaccgaagcgagaaagactttttaataaacacgttcatacgcactacgacgagaccgctcgcacgcggtctcgtacacgcacgtacaccttaacgatcgacgcactgtacgcgagggctaagagcgggcgagcgatccaccccgtttcgcaagaaacgacgcgtcccgggcgcggctccgctaagcattcgtttacacggcagtttcggcgtctccctcctccggtcgtccgtaggagccctctgcgtttccccgcacggccctcgaaaccaaactccacagactcttccagacgtttgcgacgctaggctggcccggggcgcggacgcggtctgagggcttgagccggtggctgcagctcgtgagagcgtgttcgaactctgaaacgtaaaacggtccggctcgattccggataacgcaaacgtcttttcccctcccccccgatccggcaggcgagaccttcccactcaacctcggtcccgcacgggcttgggggggggggggggagggaaatagccggccgaaccctactcgggcccggacccaaacgacatcgctccaaaagagagcgttccgtttgacggagcccgcggtgcgtacctgcacgggattccggatcccgatcccatagcgaccaatctcgaatactgaactccgttgttccgtcggaggccgttaacacatataggggcaattggtctgggctcacgattttcattgtcgccgcaaaagtgagtgtgcttgtgtgtgcaacaaagcgagaccctctaccctgttcgtgaggagagggtcgcggggttgcatatatgtggcatatgcgttgatcacgggaccggtgagctgacaactcctccccgtcagggaactctattccccgcattaccacatggacgggccgcggcgtcgcggcgtttcccacacccctccaccgaccatgccccacccccgctctcgttcgagaggccgtcccctcccccatttcgttccgcctcgtccagagccagcgcgggacttcactttttccccatccctctactcctatctcgttgcccagcccacgatcgctatgtacgcgttctctccgaggccggctcgcgccgagccggccagacaaagtcacttcggaactgacgccgaagtgagtgctgaacggttgagggggcggcgtatcgcggataagctattctcctcggagtctttttgcggcaggccgcaagcttcctcgtacccccctttcggggttcgctagaactcgatcgaaacccgagacgagttactactgagccgatccctacagctcgggaccgctcccgaacagaacgcggcctcatcgggttctttcgtagagcgccgcaagggcagaaacggaccgacgcgcgtccgagactcatcccgagctcacgccgaacggctttattgctccgcttccgaacgagagagcggtcctatctcgaccggcccgttttcaatcgattcccgaggttccgacctcgccgcgggtgcggggccggggggaaagtcggggggcgacccgcgaccgtgttccgcgagcggcgttcggccgcgtcgccgacgcggggtcggatctcgttctcgtgcgagggatcgggacgatccgcggacgagaacgatggggcgtcctccctcgacgtccgacggttccggacgccgcgagggtcgcggcccgaaggcggagatgccgagctcggccagttcgatgccctcggtacccatcccccttccacccgtcggcgacccccgcgaacgcgagccgtagacgacgttctcgggacggcgcgcgatcgcttcccggccgcctgcgatcccaacgggacgggttcgttcgccgcgcggttcgcccggcggtaaaagaacgaccagaaaatccgatccgcgacggcgggcgctttattaccgcggtcccgcgctttcggacggcgggccggccagcggaacgacggtccccgccggacctccgctcgcgtatttgtaggccggaggtccccgaatccgcccccgtgggaggggggcggcgtttctagcccccggcgcgggccgcggccggacacgaacacgtggcataggatcccgcttcccgattggcccggacgggcgttcgcaccttgcgccaataatatattatatatataatcttatattggttcgcggtgcgaacgctgacgcgttcgccccgctcgtttgcattgcatcacgtgatcgttacgccctcacgaccggcccggtcataagaagcggaggcgccggatctccgcttagagcgccggtccggcgcttcccgcgaacggacgcaaggtggcggcagaggataagcgatcgccgaacgagagccccgtcgggagcgatcccggatcggacgccgcggcgaacgcgtaggtttcggccgtctcccccttcccttcccccacacatcctcccgccccccacaacctcctccccggcggcctcggacggcgcctcccccgctcttcccgaactgcaggccggccggctaccctccctcccccctctcctccttccccccctcccccttcttctcccgtccgaccggcccggcggaacgcgatgcggcgggggaaaaggcgccgatccgacggacgcgatcgcgacccgaccgctgatccgcgcgcccctccggacgccgagagggatgcggagcgcgagagcggagccggggacggagggggcgacccggacgccggagagaacgacgccggagggcgcggaccgggcgcggacccgggcgacgacccgggcgacgacccgggcgacgacccgggcgacgacccgggcgcggacgcgggcgcggacgcggacgaggcgcacgcgcgcctgctccggcgcgccgagcgcgaaaacaagaaactccgaaggggatgtaatttagtgtttactataagcaacaaaaccctagtagtcggaacatgttttatgcttgcggcaggtgtactagtcggtgcaagtggtgctgaccacgagactgcatgcaacaaaactaatttgctgttggtatttgttactgccctcttgacacgatttatttgaaacggtaacgaatgctcgtgtactttataattgcatgcccgattacaatctgttctgtaagaatagttatacgtagcgtgttttacatagtcttcgatgtatagaagagacgcagtcaacttgccggtgccgtgaaattgtctccacactatgatgtttttactgttacaaggtaattaaagaccttcgagtttttcactccacttgtgtgacgctccttcgattatgagagtacaatgtcgtctaagggggatgtggatcaccacgcgggttatggggtggcactcgcaattattgctctattgctcgtacatgctactgcactgattatggtgagtgtctttttacctctgtcccatcagtaattgctaaacaatgattgttttaatgccaaaaatctttttttagatcttttctgatgtcaaattcagaccagtttcacaggatcttagtacgcagtacccatctcataagcattatgatgatgcgtactcgccacatatgtctggggtagaccacggccattcggatgtatggactaacactgtaaatgacccatccggcggaataaactcaaatttgcctggtgcgaagagcgtggagaagatctatcctagcgtagaaccaagtacgtcgcatgacaaagtgtcgtatggaaatgcatggggaggggacataaacaccggcagtgtttcaccttctgatgacaaagcattgcccgccactgtcgaaccatcgacggacatcgtttccatcgcgatcacggggagcagtttaaacggagaaagtagttggcggatttctaaggatggcccgcgtcgggtttatacaccacaccagactaaaagaagtcctcctcagatcgatggcacgcgtttatctactagaacggcatacttgagtgtgtgggatgaacaggaggggatttttaaaacgttcccggccaatgctgctgcattcaatttattggacgctaatcagttagagaaagcgcgccgtgaagtttttttcgttgtgtcggtgtggcatggaaatacgaacgaaacccgtatatttttatccgccacgaggctactgacgcgaatgatgtccacatcgctcgtcgtttatctttcctgggactctcgaggggccctggggacgacaactgatgcggcttttctggcacggagcgtaaatatatcccagttcctgaccgctgtaccaccacattcgcaagttcgttgtatgggccattcattaggaatgtatacttgcggttccatctgtagacaatataatagtgtaggtacgaccagatgcaaaagcattttaagtattgatccttacggcgcctcatcacccgagtctcatgtatcctcggcagacagctcaaatacaatacgctttgatgccgactatgttgcgattttcgcaacaagtaagtggcacttgaacacgtccgattcaaacgcagacgaatatataatagtagatggcttgaatgcaaatgctgtgtgtgtcgatccctacgagtggagtgtcttattgtgtgttagcaatcgccaacgaaatgccgtttgtgagcgattcggtgctaacaacgtaacgactaccggcgaccctgcggaagacggttcggaaacatgcatgcgaatactccctatactatcggtgctgcagtcgctcgataagaattctgcgtatccgctgttacgtatggatccgccgggagcttctgcagcggtaccatccttaccgtccacatggaatatctacgtgatgggaaaggattacagatattctacttatggaaaaaatgagagcctgtggtattctagcgccgtgcatatgggaggaccgggattctttcctgcgtcggtatttactgtgtttcttccctcgggtatacccgctgtggtatccaatgtcgtgcaacacagtagcatcagttacggagatgtagcggttcattccgctttcttaactgataggtccctctactacccccgagtgatggtccaaacatccgggcctattttatctgcctattcttggagagcgcgactgcataatgacagcctctatttattaccacttccagaacaggagataatgcaatacaaatgcgcagttgcacagggaagctatgcatgtagtcccacaggcccgatcttgacaactgttatgtggcgttcactgttattcgcgggcagatcttcgccggtgcccccaaacggtagttgtttgacttatatccccgctaacacaatcatccggagccggtcccccattgaaataggccctcgaagtattataactgcatcgtttcagctaagcagacaattaatggctatgacgctcgaaaatcatttcacgtccacgaaccggactctattgacatttcatgatgtgtgccacgacactgctatggagtcggatatatacttcgagtataactggttaggcgcatcgatgaacattaccatactgaaccccggcctctatacgtttagatggtttttcccatttgaggttttcgtaatgccggtggtagttacgcctcccaagtccagagcggataccgtcacgatcgctcccgtaggactataaccctgttggacaaataaagtatacagactgttcaaactgtgtagtgagtccatcttagtcgtactggatgcaaacgagcccaataaagtgtaacagttgggaaaactttaactgtcgtgggataacccttataatgttatagtgcagtgactgacttgtaagcaaacattgactggaagttagcttatactgtacttcgtcgagactgccgttgccgactgtacgatggagcggcctctcgatcgtgactatcaaagtgcgataacgtgcttgacgtgcgagagagtacttttttgtcgcctctgacatgggcaggttcgtggcgataactccaactacatcaatgccaagaggtttaagcgttaggtcgccggtttaaatactcattcggaagccgtgggtggcgcctcgcgtaccccagaccgttgtgttataaaacccagactcgtcgccacacatgtaggcaaaaaaatgactagcgaaagagctcttgcgctagcacccggtcgggcggccacggcagatttctacgaagtggatccggtatatcggcgagacttcgcacgccggcttttacaacgtaagttccagcttgtcgtgttgtagaggtatttactactctgatcttcacctaattagcaccatgccgtttgtatttaggtttattccccaagacgcttgccgccgtcagggaatcggagggaggccgaaacacgcgcccgcccaaaacagatctgtgtacgcttttgcgcataatcgcgcatcatgagaccccgcacattttcaccccaggtcccagactcccgaaatcctcagcaattgtcgacgggctatgggtagcgtgtcgaggacttgcggcagagtgcatgttcgatggccgggcgacaatagagttagcagaacgcctcgcaacttcatggttgacggccataagattaattctagtttggcatcccgtgtatgccctcggccagcaacacgaaccactcgagcggatatgtcgccaaggtcgagaatatattgctatgctctcgggaacgattcaaacatcgtatgcgacatggccgttttggcaaatgatgcaacgatgcttagattggtgctgctcatttcacatccccgatgaccgttcttgtgagcacggatctccacgtctggggatccaactagagggcgaaaaccagatattcgcgccaagtttggggctctactccgctgtaatggcatggaccccaattccatgtcacgtacaggttcctgtatttccgagacctggcgaatcggacgatgtctcgaccccgcctagtggggcacagataggacgggtgcgacctcacagtcttcaaaggctggcactaaaacacagacctattgatgccgatgtacatagacccatgccgttaggccggccactcccttcaatgcatatggacgatccagacgatccgcaacctggaccctccggacaaggccgggcgcccagaactccaactctggaaggagtccgggtcgcagaacaaccggtaagtcttcgccgcgcaagaacaccaccgccgccgctcaatgtcgacgaagacgacaacgatcttcctcccggccaacccccccgccctcatcttcgaactcccccatcatcaccatcgtcctccgagactgaaatcgatgaggaacttaacgcgcaacccgatccttggggtacaaaccgtagctctacccctacagataactcctctgccagtgaggatgaagccagagggagcgggttgccccgaccattgcgcagcgcgactactgaaccgcgcgtaacgcgtagaagccgccgtgaggctcgcagccggagccgaagtcggtctggagaccggaggtggggaccgtcccgattaaggtcaatgcctggacgcaggagagcttctcgacaagatacagtacttgtagacagttctgaagaggaaccgtagccgtttgtagtcagggttctagttaagtaggcgccgcgcgatttacgaattagtacatttgggccctgccgcgcagcgagcgtctcacgactgcgatagtcatgcacgtttcgctggtatgggtgctgtgtttgcttttcggaactagtgggggtgttttaaagtggtctgacgttgacttgtcgcggggattcatttcggtcccaaatgtaagttcgcttatgcttttagactgcgctccaaattcgatactctcaactgccagattcgccgatctgacaacagatgatgtccctaccggtatatttattaagatcaattgcagcgttccggaattcattttatggtatgggtctaaaagcgtggcggcgcggctcaacccaattattgcaagcgctttaatgatggacgatgttttaaagagcggattggacgattccgtgaaggcggaacttcgcgtgtttttaaaaagaatatccgaacggctaccttggagctctctccggaaaagacacggttgtctgaacctggacgcaccttatgacttctcctgttatggctcggcacggctcgacagatttgaacgagacatcgaggacgatggccgcggaatgtcatgccgagctaaatcaacccgagctaaagcggcccgcaccaacgccatcgagggatagttcggccgcgattaaaaagcgtcgccggccgatcggacctccgcccggtttcgcgccactgggcgataatgcgccatccccacagggtgaaactgacgcgtacggacatcaactgtcgatgaccgaaaacgtccgcgctgaattgtggcctgttatagccgagtcttacaacatagactggagttggaaagattggctgctccccgaattatgctgtcctaacggctccaagttgttggcggaatacgaacgccgtgctgcggtagaagacgtctttcctccgcgagcagatattttcgcgtggactaagtactgcgctccgcccgacgtcaaagttgtgatcgtcgggcaagacccgtacgttcatccgggacaagctcacggcttggcatttagcgtcaagcgcggcattacaattcctcctagtctgcagaatatattttcggcagtcaaggcgtgctatccctcgatcgaactcggagcccacggatgtctagaagactgggctaaacgcggagtcctgttactaaattccgttttgacagtaaagaagggggagcccggatctcatcactctctaggatggcaaactctggtgcgaaacgtgcttcgaagactgtcgttgtcgactcgaggcatagtcttcatgttatggggagcgcgggcacagactatatattttcaaacggatcgcgacgatcgacatttggtgctgaaatacagtcacccgtctcctttatcccggagaccgtttgcgtcctgcacgcactttaaagacgccaacgagttcctctgtaaaagcggtaaagggggcatagactggagcattggcgcgtaagtgacggaagggttaatcatcacatgcgtacaaaagtcgcagcgctctaggacttgtcgctttctgcgcgcgcaatgaacgataccgcaccttctgttttggcagtattatccaactggggttggaagagcacacccttgggcaccgtaggccccgtcccgattcgcgacgagactgagtgcgcgcgcgaagaccttccggcacatgattgcgaccactggtgtaaaaccgccaatgcagaaaacggacctatggcaccctccccggggaatcgagattttgcgggaaaccaagaatacacacatttcgacactctgtttatggtctcgtctctcgacgaattgggaagacgtcaactgacagatactatacggagagatctaaggcattctctggccaagtttacaatagcttgtactaaaacctcctcgttttcttcctcgcacgccacgaaaaaggttcgcgcgaaaatgtttcaaagagggcgtcagagcaacaagagcttgcagatgtttattttatgccgcagggcacacgctaaacatatccgggcccaactgcaagcggtaattcaagctcgaaaaccccgcaagtattacacccgcgccgtggacggaactacgcatccggtggtgcccgtctttgtatacgagtttgccgccatagacgttgtcagtttgcatcgagacaacgtgatagaggtagacactcccggctcgtgagcttctcgccgctcatcatgttcgtcgtttcggcagctttagcatccgcatcagactacgccgcgtttttgcgggacaacaagcaagctgctcgcaagctgcagtttccgttgtccccgatgccgagccaacggatcccgcatctgtctaaggatggcaggactgcagtcgcccgggaaacggggtcgagcgaggttatgtcagcgagcggacagaacgcgtcgacccgaccggtcgacgctcgtttcgccaacctagacaccgagaaatgacaagaagcatctaaaacgcgcttgattgtcgagtggctgaataaaatctttattgatcgactcgctttcctatttctgatttaataaccatagatggggcggggaatctataaaataggcaaggtccgcgcggattcgagcacatcgaccgcgtccgcgacacagcatgcaagtggcgacgaacggtcctcaggcatgcacgactggtctatctgtatatctgcctcgcggatcgcttccgtgagaaggtcttcctcgtacccggttgagaaagcgtccactttcgagggtccgtacccgtgcacagcgccaatttcgtgcgcttcgatgcacttactaatctcgggcgcgttttcgggcagagatcttatcggatcgcagctctgtcgatgcgcatctttattagggtctgcgatcgcttggcaatacaatcgcgcgctggattcgtgaccgacccgcattgcattggctgtttgtgtcaaagagccgggcttaccgtagatggtgatcgttatgtacagtgacgttcccatccacataacggttaaaattcctccggaactgctgtataagtaggcatccggccccgtcacggtacacgtagcaaatggtatgacgcacagggattcgggcagaaaggagagcggcgcggcatggtattcggcgccgcactcgccgacgcgtagaagataagagcaaatgtccgcgccgctgtcgacaatgatcagggtacctaccggtcctcgctgtatgataaagttcgacgatgggatatgatcgcatctggtcatcttaccaacggcaatcgagcgcgtaccgcctgcacatgagcaaaccatctgctcataaggaggcattgtccacgcgggctgagcagtgacgttctcaagcgtatacgcgatgaacgtggaccccatcatatccacgtctcatgtgacggccctatgcttcatggccctagttagtatacaatgtggactttcggatcccggagggcggctaataagtgcgcgctgatattgttatcatccctagtatgcgtttcccgaagtgggttaatgttcatcctcagaaacttagaggaggtcactcgagacatggccacgtagacgctgctgagtttgatgcccgattgggcaaaacatatagcaaccctctcaaggctaagcccttgcgatctggcgatagtcatcgccagtttggagcttattccgtagtcggcggttacggccatccggagttcctgatcgtctaccgtttcgacaaaatcattgacgttggtgttaattgctgccatgaaaccgtgttgatctttcaaaaccagggtcggcatgtgaagttccccgagcgcttccgcgacctggggatgtatcttacgtctaataggctcgtctgcaaatgtgttaattctagcgtatgtgtaacccatgagagtgtagctgtccgtctgcaaagcgagcgatagcattcctccgcgcatgctatttataaatatttcgcaccctttaaagctcacgttgtcgacataactatcgaatctggacgctgcaaacttttgcccgaatagctccgtcaggatagaatacctgcccataaacatgctcttaagcatgctgaactgggtatatatctccgcagaagtttctgcgcgtccaaattcgtaattgcaataaagcatgtctatcatctggtcgtcgaaatccataaatagggcatcgtctgtatcctccacatgactgatttggtcattagctatacaatctaattccttctcactgccatagcggtgtcctggaatcgcgaacgactccctctgctccgctctatccggaggttgccgtcccggatagagcagcgcagaggtaagcatcgccaatctatcgtacgcgcttttaacagaattgtctggaagaccctgccgttgcagatagttgtagaactgtatcatgccgttgaaaagcagttgagataagaaacggtacacgtattctacagacccatctccgtgcgtctttatgaaggaatcgtctttcaatacggatagaaatgtctcgaacgtcccgcaaaagccgaaaacccacttccgaagtcgggtagtaacagccacttggctgtttaagacataggcaatatctacacacgataccgcgagcccctgttggctgcgaatttcacatttggcctgtgtggcatcttggtcgcgactttgcgaccagttgctcaagcgtcccgcattggcagcaagccatttttccaacgtaacgtgcggttggttggcagcagtacgatatcgttcgaaactatccaaactgacgaaggtataagccggcagggtaaacactacaaatttcgtatttccggacgttttcaggtagtcgtgtaatctgctcatgtacgcgctgacttctttatgggacgaatacagacgcgtccatcccggaaggttcgcgggattgttgatgtatgcttctgggacgacgaaactatctacgatccgagcgtgctcctcggttatgggaagaccatactctaaggtcttgaggaggtccccgaactcgggttcggtgcaccgtttgttattaatgaatatcgcccagttcttggacagttctaagtacgagcgcaacgtctggttgcatataatatacgtaagaatattttcgctcgtacgcacattacacttcagcttgctatgctcaaatgtggactccaaagaattcgtttgcgtgggcgacccgacgcatatcaataccggcctccttcttctacagtactgcggcgtgcggtaaacggcgtttgtgagccaccaactgtatacgatagccgtaagcaaatactttcccagaagtccagcctcgtctatgacgattatgttactgcgagtgaacgagggcatcgaaccatgtatgccgaagattgtccacgccatactaccgcgaggcttgcttagcagatcctctaacgcgcgaatcatttcaaaccgccctggcccgacctcgttagacaccgccttcaaggcgcattttgtaatgtcggataaaacgtcccaataatacactatatcctttttctgcaattctttcatcgtcggtgggctggtcggacatacgtactgatattttcccaaattcgcttgaatgtgattacctttaaacccgaattcctgaaatatcgtgtttatgtgctgcgatgtgtatgaattgctaagcttgcaataaatattctgcgctgcgacctttgtcgtgccggtgataatacagtccaagatttcggatagcatctgtatgcacgtgctttttcctgagcccgcatttccgcttattaagtaaacggcgaaaggtagctcgcggagttctagatccaacgggctttctagttttgacgcgttcataaaatacgatagcggggggactatatcatcgctcaccgatgcgtccgccaggctccttacacgcgcaatgatagtctgtatcccgtgcatcgcagtgaaatttagatacgttgcctcactgaagaaatcgttctcccgcgacatcgtcggtcttggggaagacgggagtgacgaatctacgtatcttttagggtcggggctggcgtgttgtttatttccgatggagagctcagacgttcgggccgcacgcagtcccgccctaaaacaaattcgacggccgcagttgcaatctgtcacgcgccaatggaaactttcaagcgacggcgattcgcaacagtccctggaacaggactggataataattcaccctactcgccaaacacgtatgttcaaagaggtcctcaccgggcaattgggatatacagatggacagggcatatataactcggtacgatctacagaagccgcgattcggcagattcaaagtaccattctcaccctttctttagatgcggtcagatatgacgacttgaaagaggattggtcgaagcatatggataggcgtgggatgtcggccaaggaaatcgcaaaaaagtatggcgttcatagtgaagccgaagctgttagaatggcaaagggggtgttttcaacttggcgtaaaactcttcaaatgaccttaatagaattggttcggcacgcaacagattgcttcgccgcggccgagaaaaccacgtcctgcttctctaaatacatagactggatctgctgtttaggtatcgttccggtcgtcagaagcgagcgctctatgcaggcgtcgcggccggatagcaactgcagagatcgcgctaccattcgcccgaattgggtattcagcgatgccaccgctaagctactagttgcggatagcgttatggcccgcgcacaacaaatcgcggattacttaactgcatccatgcaagcactgactgtgatagaatacgatagggcccagatagaatataatttcttaaaacgtgaacttcgcgttaaggacgtgttgagcggcgaacgtggcgagtgtatcgttatttggagaccggtaatgaacgacggaggggtaatttttgattcgcccatgcagagaatctacaaggagatgattgaatgtcacgatttgcggatgcatgcggcgctgtgtcggctagtaaacacggcccctataaaggtcctcatcgggaaacgcgatgaggatagtaaaagcatggccggggctcaaagagcaatcgataaagttctgggagaccaaactgaaacggcggcgagctctgccgcctctaggttggtcaagcttataattggcctcaaaggtatgcgtcatgtcggcgatatcacagatagagtgcgggattacttggaggaaaccggcggacatttattggatgcctcgcccgtggatacatctcagcctggcttcgggcgcgctaatcgaccacagagttctacgatatccgatggaacttgctccaataccgctagactacgtgatgcgttccacgcgtccgtcgtgacgagtataaacgaaatgttagagggctatataaataaacttttccataccgtggaagggttaaaggcggccaataaagacttatctgcaaaattaagctctaaagaaatagagctcgacagaatacgcacggaagccctgatctcagaacgggcgcgagctgacgcctcgtgcgatcctcactgcaatccaaccatggaaactttggtgcgcgagctaaaacatgacgtaattgacgtaaccaatgcaatggaggatgagtcctatatcgcgaatagcttccagtctcaatacataccatcatacgatggcgatttgaaacggctctctaacatttgggaacaggaaatgttgaggtgctttaagatgactcgtatcaccagtaatcaaggtcgagaggtttcgatctcctactcaaatagcgctataactttattactcgccccctatttcttctccgtgttgcagatctatgatattggtgcgatggtcacgagccaagacgtttacaagtcggaggaggagttatgtaattccgtgcttgaaaaaacccgactttgtacatatctggatgatttggctctcgtctttgaggccgatgtgaaaagagctgtcgcgaagtattcgctccgtgcgggtaacgccgaaatagacttagcgcccgaggagttttcgtacggctctcatggaagcaaatgcgagacacggttttcatccgctagacacgagcgacacgttggacgctctagttttaagcacgctaaatggagaagtcggccaaaacgagaccgtagaagaactaatttggcaaccgacggcgcggatgatgatggagatccgagagattcaaggcggtcctactcaattcacgggcgtctccgtgagtaaacttcgcgtggcaagatgtgatacgcgctttcatctgactttaaccggagccgacttggatgatgaaatggcaagtgacgtataccacagtcagtgcatagttaattcggcgttcaaaggtttcgtctttatggttctcacggttacggaagatatagtgcggacgataggggttccaccccctctgctaaaatacaggctcgtgttctataacccatctgaacatttggacttcgcattatgtttgctcgtagcctatttggagaatctccatgcaagcgcctgcgacgtaacttttttcgtacaggttcaatcttttctgagatacgcatggacacgggtgacgccaatgaccaaaatgcgcagatttttatgcgccacgaacgtttggttactaaacactttgatgtcgatggggtcctgtagcccattcgacggagatcgagtactcccccattatgcgatatacagacatttgtgttctaccagtggcgtctgcgacgtgttactaaccttgtttgaacccgatacacggcaggtacgtgaccgcacgcacggcaagggacttgtcatgctcaacagaggaattatgaataaggcttttcggcagacatggattagtgatacggtctacgattggtggaccggcgaacgcgagaagttgatcggagaagaatctctgttcaacacgtataatatatgaataaagtatgacaggcactgctataaatagaccgtggtttcttagcgttttcatttatttattgcggacgaacagaaacctgtacggctctacgtcgaatgtgaatttgctgagatcgacgttaggccatttcgatgttagagcaccgatcagtaatctcgaaaaaatggacattattggtttcatatgatcgatgcacgcgatggcagggagaattacttgtcccccttcgaaaagtgaacacgtgagaggtgctatgctgccgtccacagtcacggtgtggacggcgtcgttactgaaggcgctcgtatcgaatctagctgccgcccgtagtcccaaagccgtgatatagtgagtgtggtcgcgcgattctgcgggacagctccaaaagcaggcgtctccgcgggcttcgaaagccgcggtcacgagctcttcgaacactgcacgcgatcgttcttggattgtccgtagggactcgtcggaatcgttgcatgcggaaatttcttctaaaagggcagacaaggctttcttaacttggcccgcaaacgcaggtcgggccggaaaccccacgaaatctgtttcccgcttagtttcgttccacagccagtaacaattggcattccacgatactgcatgagtgtataccccttccattcgaaactctaatctgatatcttcgggaaaccgtagcccgactgacgtggctaatttgttagcgctcttaccgcaagcgactcgtagtgtttctaaagcggtttctgttcctttagaggaatgcagaacgttgttggccccgtccgtgaatgtcccccacagtccatctttgacgtaggtacacggggcgaatccgagagccgacgcggtagcttctacctcgagactaatatgattcccgatacagataatagctctataaacatcttcacgcactcttttcaataggcctccgaactctatgatgggctgcttcaaccagtttttctcgcgctgcagtcgagcttttaccgcggcgcgcaaccgggaatgatcgggaaacagtcctagatatagagtcgcaaaaaaggcgctaaaatcaaactttgcgatatacgcttgctctatgaaagtcggttcccggaaaatacaagttatccgcccagccgtccagtcgtcggctacctgacgccgcgtactgcttgtgcgcccttttaaattttcgagtacgtctataccaggggtcggatgggtttccggatgccaaggagcaagcaggtggaaggttctcggtccggccagtggccacaggccatcggtctccgaatagctgccgacggcctttctgatggccgagggggccgccgtagatgttttcaagagcggccaaaggggaaatccgatagtgcaggcatagtcaacgtcctcgccgcgcggactggtttcggggccaatatatacaaatataggggccagccttttttccgagtcatcggctagagagtatatttttttgtgccactgcgcatagatggccaataatgccgtgagagaaaattcggcgggtgtcgtaaccaagcagtcaaaagacgtcggaaccggagccgcggtttttatgggtgcctgtgagtcgggtaatgatagaacgcgttcgacgatagtgaatattctattcgtatttccccatttgattttcttggacctgcgacccactgttttatattcgcggatgaaccggtcttcctttgtgtaaatttcgatacgggagtcgaattccgggatcgtgtcgtcgtgtttaagagccgacaatttaatgtgggctaggtgcgcgccctcagtatactccatagccgtggatacgaggcgtgattcttctacgtgcacggcaccgtccgtttttagtagccccggacggggagcacatcgatcgcccggcagaggttcgcacgatataactaatcccgttgttgtgtctacgtacatatcgacgggtgcgaagtatgcatgataaccgagcttaattctcaattttgccagcgtcacggcgagcagcgctttccatagagcgtgctggtccggcctgcaagacggccaaactcccgtcacagatccggcactggccataatcgccagtgccgcgtcggttactgaatccggattcaatccccaagctctcgcgatagaccgtcccgatacgtttaccgtagagtaatgtgcagaatacgtaccgcactcatttctaaaaagcaagtaacacagtgcggtaagaccatcggtgcggtctctactagtccatactctatacaaagtggtatagcaaatacacccccggattttctgtaccgccacagtattagcctcagccattgttgacataactaggttcgctgcgtacgccttacaaactgtgaaaatctatagcgccctctacacgaggccagcacgccgggggaacttctgccaaaaccgtctccaggtccaaaatgtcgtggtatatgcccaattccgcgtccaagcgagatttcactagcgcgtaccacttagggcgtcgaatctcgtagcgcgttttgcggaacgacgctttgtttttcataaggagtgtgtaaagcgcgcggtgcgttttgatcgacgttctatctatccccgccccatccaacaaagcttctatctccgcctttcggagattcttaactttggtgccacccggaaacgtcgtcgcgctctttacaaggcgtaacccatacagtatttcccatgtgactttaaaaacagaaaaggcgtggttctcctccgtctgccggcccaagggatacctcgcgagaccacttaacgcgcttttcgttgttttgactgatcgtttagaggcagtacgggcatccagcagataacatcgcgtgacttccaataccgaacgaataaaagtatcgtactcattttgcatcacacgcagcatcgataatggatctaaatttttagctgttccctctaaagggttaatacccaacgaggtcgcccatctgcagcataaccgatataagtgccaccttccagacacgttgaaatcggccgttattgcgacggtacccagccctccatcgggcccgattattggtaagctgcctgatgcgtaatactgataaatacgacagaacacctcttcactataaagagcggccggcgttgcgcgacacgcttccaacatcgtaatatttataaattgttctctagtaagcggttctgccagtttagttaataattgcgcaagatcgctcggcgatccgtcatgtcttagatatttatgaataaacggctccaccatctcattgtcgatcagatcagcctggatttgaccgcaggcaattttacggaggtgtttcaaatctcgttgagcgataagggcgtctgccgttaaatccgctaagaaggcgcagaaggtttcagcgtccaattgagagtcagatccgtcaaatctgacgcttattagattcgcgtcaagtaaggcgtggagaatattgatgctgtcgctaagattgttgagggtgcaccgttcaaacaaatgcttgtacttaaatcgtgggaaaatgtataacgcgtcggcggacttgaaagtcggaacgcaatctcttctgaaattgttacacaacatattggtcgcgcatacgaattgcgccggccatcctcccccactggcgatgacgtggtttagtagcatgggtgtgaaaactggctccgaacgagctcccgatgcatctatgtaaaccaagacttcgttacggcgtaacgatcggattctacctaaagattgatagaccgaaaccatatcgggcccgtttcgcgtcggcttaatatacgcgaacatgctgtggaagtgggagctgataaaacttaggcctactgttactacggtagtgtagatgacaactcggtaacgagtccatgaatttatatcaattggtatatcacgggtggaatttaagaccaggacagaatcggtaaatatgaggcagaagcgtgccgccgcttccgagaatgaaattgtcgaggaaaataagcaaatgttcaacccgcccgcgagtcttctgctgagttcagaaaaaaacgtcgtctcagtcacgcttctatgccgagagtgggtaccgtcagccccgtgtttaggtgtgggtcgtacatgaaaacaatctgattggtcgctattcatgacggagagaagtgtatctgttcccagattgcggaggatggtacatgatctcttagaaaacccaggggctgcgtattcgcccacgatgacatgtatgttatcttctcctctcatgcttgccaacatatctaccagttgtgtatttattgtagcgtccattgctatgatcctcgggcaattacgtaacagagtcgttagtatcgaatcgactctggacagatgcctcatggttggagagtaaagttgactaatggtcgacatgacttcgtccagtatgatgatttcataccgtccgagcaagtcagggtctatgcgatgcaaagattcgatttggatcaacagtctgtaaaactctctgcctcgtatgctgtagtcactagccgtcaaatagttgccgaaccccgacagcccggcattgctcagtttgtcgaataatgtgttcgtaaaacttcgcctacaggacacaaccaaaacgctcgtgtccggattatataaaatacgctgcaaccagtctatgagagcagttgtcttgccggatcccataggcgcgcgcactacaagtacattgcgcgctctcgaggacagtggcggcggaaaagtaacgggcccgtcggattggcgctcggtcgttactccgggtctgttcttagctatccaatctatgagaccttctccgtataatatcctcgacaaagaggcgctacagacatagtctatcattttctgtgcggtcgatgctctaacgtcgccgagaccggtgctccgggtgaggattacgttctgacgaccagagaaccgtctacgatcgtcgctatgtcaaaaggaccgcgatcggaaggagcccggagaggagcagatcatatagactacattcacaaaaagatgtgggttgtccaggcggcgtgtttttctgtcgccgtcttggttttcctaggaaccctgatagctgcatctataaacatgaccgaaggtttcccatgcttttttgcggccgtcgtggactacgggatgacgaacgtgacgcttgtgcatacgggcatgaccaatccgaggctgggaggcgtagttcctgtgctgtttttccaaaccaaagccgtggcgtttctcttctattcggcgagcgtcgtttttgtatgcatcacgtgttatatcgccgtaggcgccatcataactagcaagaaacgagtgggtgctgcgtataccggaaggggcgcgttcgtcctttcacttatggcatcgccctcgacaattttgttgggtactgtgtcgatttggcttcttcaagcggtagttatagtcctagcccacaaacttattgtactagccgcggcggtttatttagtgcacttctcgactataacgtttttttatgggtatttctgtggaaggggcgttgacagtaaagtatatgcggaagacatcgctgctgcgaaaaacgtagacgccggtctgcacagattaattggaaacgggcgggcggtcatgatcaacttggtttcgatcgtatacagtatgcttctgataatggcgtctctaatgttaggcatgttactagcaaacagctttaccttaaagttttggcatgtcatcgttaccgtcctcataacttcctcagtcttaaccctaatgtatcttttagtactcgagttcctagtggcgcggtacgtgcacatgattttgggtgcgtacataggccttctgatcgcctatgggatgctctggaccacctcatgtgattatgtcaaccggttctacttcgcgatgggcgtaggagccggcaacttacgcactgcctgtcacagcgtgctggcgtttttcaccgtactgattgtagcgggcatgattgttcgcctaatccgggccgggttgtatcaccgtaggcgatctactcgtgcatacgccaaagccaggcagttacaaagaaatgtaaaggagagattgagacgaatgagtcggggacgcgatcgtcccgatagccgagctgaggacgagcgggcgcttacgcaaacccaatatagcgaaacatcagacgacgagactatatatgatcgcgtttattcggggtctgatagtgaatgggatgaataggaacgcccgaaacataataaaacgctaaatctacaagtgattgtcgcgcgacttatttatcactataacgtatcgttacattgttcccgaccgtccttaaatctgaaaagcgtctttcctctcgcgcaagtacttccagctaagacagtatcggaatggataagagggtcggaggacctaagaccgtccaaatcgacggtatcgtattgctcgtcgtcgagctcaattacatgtcccgttttggtcagaacggtgtttcgtttccgacagcgtcggaacagttccgttacggatattgcttggcccatacttgctgcacgagttcaccgaacgcacggtatccggcctcttctacttcaccgtagaatgtaacgtccacgaccacgggagtgatgaggaggagaacgggaatcgcttgttcggggtctattttgacgcttggagtgggttctccagtgtttccttcggagatcgtcaggcgtctacctaattcgccaggtcgtctgcggcggcctataaacgtggcgaggtgtgggatgaccgggttgctttcaaagtaattagaagctacgtagttctgaacgaaaatctgcttgaaatttggatgtcgtgggttggcaaatatgggcacaaggacagattgttctccggtactccagcatagcgggtgtatcgcgttcgtttgcagatcaggttcgccaaacagccatacgcgagaactgcagttcttattggaggccaagtgacgcgaatcaaagtcgttccgtttaatgtttgatgaaatggcgcggaagcgtgatagccccactttccagtcgtcgtcacatgtgattagcgcctcctttgccttaggaaaatcgtcaggtttaaaatagtccacgcaaggatgattgatggcgtataagaatcttcggagcgctgcgacggttcttgtttgtaataggcgttcgtaacattgagatagctcgcttcgacattccgggtaaaacgcgtatttggccctacactttatttcgtacgtttctatggagtggtcggggagggcaggcgtaaggattccgcgtgcgctgcgagggcataccgccatatcgagggatgctccgagcatcccggttctggcgtctatcatcagaccgcacgcgtatttgtcagaggcggatgagacggtgattgtctcgtccggtacgcgtgcattttcgagcacccgagaaggttcgcgaggcctgtacctggggttctccagacaataggtctctatgagcgctctcgcgagcggctcgttacgcgttccgaagactacgctttcgggcattccttgcgccgtgatttcggcaggtcttatgccaacggtgtttatccgtccatcggcggtccacttcaatgtcgatgcggtcaacagccattgtctaagtacgtgccatagctcgcagtccgcttgcggtctggtgagagtttctacaattttacaccagaaaagcgcatgattagacggcgacgttgcatttgcgcccgattcatacaggagcttgtcttccgcctctaggagagaagaatatgaagatgccggccaacgtccctctgaaatgcctcgtttgataacgtccgttatgtacaataagcggtgatacagcgggtgtggcgagggccccgattgcttcgggtcgacattccgtaatatatagtcgctgaaggtataatcgaccacaacactgtagcatacggtatcgtaaggtttggactgcactgcttctgcgtgctcggcgcaagcgaagacctttggacacgatttaaattcggactcctttttacgtttccgtggcccgttctcgccgagacggaacattgcggtggagtctatttccataacagccgtgtagcggccctcgcttctgagttcgagtgacagtaaagtgcaacgagctcgaaaagattgcttaaatatggcgggactctcaatgaatcaaatagcttcctgtgcgtcacttcatatccttctaaatatttctcaaacgcgaccctgtggtgagagccgtgtagctgcgaacgaatcttttcggctcgttcccacgggataccgattttggcagttaacggggtagctggaaataagtactggtacagcatacaccgatacgctaacatgtctaaaagatagtcggccggcatcattttatggtaataaaaatgcaccgggtttccggggatggcaaagtcccgcgtaaaattcatcccggcggctagaagcacttccatcagtgattggcccagtgcgtacatatctatagcgacaccttcatcactggacagttgacttgaaccccgctccaagcccgtcccgtttaaggctttaaccagcaattcgcagggctgcgtttgcccatgccccagcactaaatcaaatacaggtctaatgtttgctctagacacttttactgaatatactcgatcggagtctacagttatgtcgaatcgggctttcgtaatggtggagtttgtgttaagtaacgccaagctaaaatcgccgattacggcctccactataatagggttagacccttccctgacgttgacgaaaatgttcccgcacttaatatccaaatgagtcagtccgcaggacacgttcaagtacacaacggctctgccgaggcccatgaacgctttttctatggccctccaatggcgtgcagttttatccatcttcctcagtcgatggcagtacgagtccatgtccatgtcatacgctggaaataccagttccctggatggtatcgaaaaggccagtaatgaaatcacgctattgagcgctagagttgaccttgcccgacaagcgcattcgccggctatcagtgtcataagcaattcggtcttgaaacactcgaacacctttttgacggctacatttgcacccttaaatactttaacttctccatagctcccgcttcccgcatatattggcgtttcttgcaggtcgatggtgctgtaatgtaagcccggggagatatcgaaaatgagcgatgttatattctttatgcgagatagagtgaaaatatgatccggcaaagatggtcttgatagcaaaatgtcagatgttttcctagatatatgtttgcgtctcctatagaattgttttaggcatctcctaatgttgacggagatgtgttgtttgtggtccttttttctacacgaatctcttcggggggcactgaatgttccctgcagatcgtctgttgtgcttgagtatcccttaggcccgctgaagtcttcttggtcgctgatgtcggaaagccatttaacgtgaggacactcgtcgttttcgcggccgcgccccggctttctggctttgaggtcaagatccattttgacagcagcgcctcgcactctgcgtccaattctatgtctggaaggcgatcgctgatgtcgtcgctgatttgcgttaagatgtcttcgtttgctagaatgtcctcttcggcacgatccaactgtgactggagcctagggtttaaaaaccttcggttcgcatctaagacgatgcggcggtccacctgttcgtctatgtggcgttggataattctcgactttctatgagcttcttcgatccgcatgttcgagtgcaactgggttttgtagtcactgtgggcgtttctggctgacgttaacgcttcgatgagttctgggtcgtccgcttctacaccttgggacaaaagtgtcaaggtgcgttccttataaattttctcccgcgttcgacactcggccaatatttgacgcctgcgtctgcgtattgtgttaacggcgaacatcgctcgacgagattcgtagtctggcgattaccgactccgtaaagatgttcggaggcgcgctcggagaatcggcgaagaagcactttgaacgcctgctgagagataggaacgagcgtttaggtgcgagccgtaaaaatgaatgcctcgcgcgcggcgggagtttagtcgacgccccctttctaaattttgcgatttcggtcccaaggcgacatcagacagtgatgcccgctgtcggtacattgcatgactgctgcgacggtactggtatttactccgcgatcgctacacgcctgctgtatgctggtatcgtaagcagcgaatttggtgaagtgcgacgcgagtcgttatctaacggtcacatatcgaaaaggaatcgggaggcgttgcttgcgccgactctgacacgcgtcgccaattccataacatttcacgagtacgacgatgcacaatgcgcggcgcatcgcaacgcgtattacagtacgatgaacactttcgggtctatgaggacatctgacgcgtttcaacagctggcgtcctttatcgatcgattttcaaaattattagctgcctcgtttaaagacgtgaatattttggacagaaataacgctcccaaacgagcacgaataaccgctccctcgtacgataagcctcatggcacgctggagctgtttcagaaaatgatactgatgcacgccacttatttcttaacgtccgttttacttgaagaccacgcggaacgtgctgaacgtttgctccgtgtcatatttgatatcccagacttttcggacgcggccactagacatttccgacaaagggcgactgtttttctagttcctaggagacatgggaaaacttggtttttggtgcccttgatagcactggccatgtcgtcttttgaaggtatccgtattggatacacgtcacatattcggaaagcgatagaacccgtttttgaagaaattggggatcgtctcagacgctggtttggtactcagtgtgtggatcacgttaaaggagaaaccataacgttttcgtttcctagcggatcgagaagtacggtaacgtttgcctccagccataatacaaacgtgagtattgcattcaaaaccgttgtgtcggatggtcccccccctatacacacacccgtgatagtctaatacacccttgaaccagtatcgaactccacatctccggcaggtagaccaaatgccatccgcatgaatttacgggaatcttcctactgtctacctcggcttcgattaactcttcgagccgttctgtaatgcacgccttcgtgccgctattaccgaccactcggacggcatttaccgtgtccatgaataaaacgcaacagaggcttttttcccctttgacttgtatatctgtctgtcgggctttcatccacatacacggacctctgcaaacacaagcctgcccgagcgatccgcactcccatctcacgttacaaacatccacgtgaaggtcgaaatgcccacggcattccgcacagccgctccggtggttaagaaattttgctagagtagcgcccagagaacgttgctgccaaccggcgggacatatagatagcaaactctcttccatcctgaggtaataaaacctgcgtttggaaagggaccaccaagctccaatagatatcgctatacagttgtgtggatcgtctggcggctgcgtgcgttggactagggaatttatgtccggtgcgatacaagagatagttgacaaaggttctatggcgacgtccggaagaccgatacaggtcctactaggagcgacgtcagaaaagaaaataagatctgcggaagatccgtcgcgcagaatgggggttatgcgtaaagcggcagtcacggaataggcgcgcgtcccgttgactaagaacaagagttgaaaagtgtttctgtccaagtacatctcctttggtcgcgtaaggtacatgaatatctccacccatttcgtcttttgcggccgagcgcccagcggtacgtacgtacataacgtaaagtctaacgtggttaatgcgaccaacacagctagacgcgattcggcccgaagcgtgcgccatacgcaaatgcggtcatttaacttattaacgaactcaactgccgccgtatcgcaagtccgttctgaacgacgcggcgatccgggcgtccttcgtcttcgcgtagtcatcgtcccacatctgtatgacgctaccgctaattgaatattcgagtcttggcagggcgctcatggaaaagataatgtagtgttgctgctgcagaggcgcgataaaaccgcgtccgcccgcgccagaggccaattgaactcggcgccggcatgcgctgctaacatgaaccccgcgggcaacacgattgcaacgcgcatacgttcatcataacctacgcaaatatacgcataactttctccaggaagaaatctttcacacgttgcgcgcgatacgaaccattcggggaatgcgcaggttctaatagattcgtcgcccggcccgccgggcgacaaatgcgctgcgtcacgcaaaataactgggataggcctcttatttaacatcatacattctccgcccgcgctataataatcaaataggaaaagattcggcgtcctagtagcgacgggttggtagtcgcctcccaggacttcggcattgtttccagtcgtatgtatgtaatatgtttttcctccagtgcgcttaacatgcctggccagaaacgagatgctcgcggacctaagagcgcctactgaaaacttctcaggcgaagaactcgcgattgcctgtagaactgcgcgtactgaatggggtgtgcggcttgcgatttctgccacgcactgaacgtctcgcgcatacacgtcgtagctgatcagctgatatagattgggccctgttttcaacgcttccccaactgcccttatgacacacgcagagacatacgacttgaaattaatcattaattcggtttcggagcccggagaaaacgcacgcagttggttttcctctgcttttaataagggagcagccaaaataggagcttccgttgcgatttcggtctttcttctttgtggtagacgagaggggtgatcgacgccttcttccatacaagcggtagcgagtaaattgctcaacgaagatggaattgtggcagaatcggaggaacggccccctaaggcaatcgaccgctcatacgatataagataaagtgtttttttggtcatggagtgggtacgtggaacgatggatatgcccccgcacctccaccggttcgcaattgtgagcccgtccgccaaaatgccgaccgcagaagataggaggtctttggggcttaacgaattttgcgatggttcatcgaacatgagaatgtcttccaaattcaatgcagtccctgtagattgctggtccttattacggccctccaagcccctccgagtgtcgtggtttctggcaaaccttcctttgcccacgggctcgagaccatctatgacggctttctgtgacacgctgctactgggtgtgcacaaattattttccaaacaagctatcgccccttggcgcaatccggacactacgctggcgtgtatattctccgccggccgttttgcgcttaccggcgctcgcctggtgatagcctcggctgccttcttaatgagatttgcgatctctatattgtctgtctctagtcgcgtgtcgagagtaggagtgtcgaagacgttcggagaatctgttacttgccgcataatgtcaaactgaccgggcagttcgacggcggataaacacgcctctaatttagcccccaattctataacagccgacggtaattcgacctcgtatctcttagtatatcgtatgaattgacggaagagcgtctttaagcggttcgcatcgatatcgtatcgagtacctggaggaactaattcctcttgactaaacagtaaatccatgtacgcttcgtactctccggtttccctatcctgtacgttaaagcgaatagccacggatgtaaacggatcaaagcggttcttagaatcatattgtatgggaagactcatgaacaatccaccttgatcgtttcgattgagcgtcgcgaaaagtttggcgtggcccgggacatgaggtatcaagagtatgtgtagtgcgccagagggaacgtaggctgccggtgattcgcgccaaccggaacatttaccggtggcattatagcgcatctgaacacttaccggaatcggcagcgattggtaagcactgctgggtactctctgtgccgcatccttaaaacgggcgatatctatccccgctgccgacaaacactcatccggtaagaggacatgcgtcagtacgtgccgattggggccgtgtttgggagtagatagcgaatacgcggtctcgctctctatatgcgcctccatcctgcaccggaatggcgagtcgggtcctgcggtctagatagcgtcgcgtcgccgttaatgcgaggggctatgcctttacggaccctctcgactcagcattgcttgtttttgtttctgcagagcattcgcggccaagatttcaacttgctctttgtcgacgaggcgaatttcatacgtccggatgccgtgcagacaataatagggtttctgaatcaagcgaattgcaaaataattttcgtgtcgtctacgaacagcggtaaggcgagcacgagtttcttatacggtctgaagggatcggccgacgatctcctaaacgtggtgacgtatatatgcgacgaacacatgaaacatgtgacgaattatactaacgctacgtcatgttcgtgctatgttctgaacaagcccgtgttcattacgatggatggggccatgcgtcgcacggctgaaatgtttctccccgactcttttatgaaggaaataatagggggtatcaccatggatagaaacacgtgccagggagaccggggggtttttactgcttctgctgttgagcggcttcttctatataggccgtcgactgtacggaatcaggatatcctctcgcgagacttatacgtgtatgtcgatccggcgtttactgccaacaccagagcctccggaacggggatagccgtaatcggtaggtatggagcagattacatcattttcggccttgagcactttttcttgcgggccctgacgggagagtccgcggatgccataggagagtgtgccgcgcagtgtatcgcgcaaatctgcgcgatacactgcgagcgtttcggaacgataagagtggccgtggaagggaatagcaaccaagattcagcggtagcaatagctactagaatttcgatcgacctggcctcgtacgtgcagtccggagtggcaccggcgccacacgacgtttgtttttaccacagcaagcctgccggcagcaacgtcgaatatccctttttcctcttacagcgccagaaaactgcggcgtttgatttttttatcgcccgcttcaactcgggtcgagtactagcttctcaagatttggtttctaccacgattagcctgtccaccgatccggtcgagtatttgaccaaacaattgacgaacctctcggaggtggtcaccggcgcgacaggcacaagaacgttctctggcaaaaaagggggctacgacgataccgttgtggccttggtaatggcggtatatatatctgcccacgcgtcggacgcgacgttcgctcctataagaggagtcgaggccacgtgtcgcggcccaacagaagcgtgaccggccccgaagcgtgaaatatatctgccgcgtcgcaggaaaagctaaccaataagcagactcgcataagcacaaaccgtttattagaaggctacccgatgaataaagttattttaattccagttagaaataacgggacataggtctccgacttttatactcgcgggcccgtcgaacgtgcacactttcaatagcgggcgcagcgctagcatgtcccctagatgcagagccatggtaatccacgaagacagggcttcgtaaatgggatatctgcgccacgcgtcttgcaaaggcgggggtctcggaattctgatgagctgacctactgctctcgtggccgtctggagacccaccagggcgttgacgtaaccgtcagacgctcccaaagtaagcaacgtcggtatcagagcatataggagcatgttaccttcgtcgatagcgaaaatcatgtttagcaataaggttctcactgcagactccgacgcatccagactatggagcgtcggactaatggtataggttttcccgttatatgtaatggattccgcttcacggctcgtagggggaggcgctagccctccgccgatcgctatcccttccgtggctcgagatagcgtcttagcaataatttcacgtgcgagtctcgccggaacggttgatggaaataaaagttcggtatcgatcgattccaaccggatacgggagcaaacgttagggaaaagcggaggtatcaggcatacagcatccccgttacataggtcgaacgggccggtgttttgaagtgccaggcctgaaggaatggtccccattcccaaaactacagcactcattcgaccgggtagcgcgcgggtgacgacggccgcaaatcgtcgtttgtaggtcgatagcagactcagcgtatcaggttcggccccagcgatgtagtatgacttataatctacttctttgagcagcactctggctctgacggacggtaaaaaaagaactcgcccctcacatcgttgaagtaggttcgcgtcgcacgtagaaagcccgcaggggagctcgatctctactgtcgtaccattagaagcggccataacggtaccgctggcggtttattttcggtaccgacggcggcagcggataagtgtataggaaccaggccgagccgctgtcaggtcaagcacgtagaccgcggaaggttagcgatcggcgagctggcagttcagcatgcaggcaagcatccaccgatcggcgaagcgtctttgattaagtattgagccaagtgcgtttctgggttatccgcaccccctgcgaaatacgtgcggagcaaagctttgtcggtagcgcaaagtagcggataggcttcctgaaatagggaacaaggatcttcgattaattccgtagatccgactggtcgtttgaactgtacttctccgtccgacgcgaatgctgccacggcagaaccggcttcgctgattagtttatccaagcaccggcttttgcagcacacttctgccggggtaaaaaatttataggtgggactgaagaggggagacgccccgctcaaattgtaagttccgttatagagcttgtccgcgtaagagaatttttgcgaagcccacggattgttggttgcgcggaacggataagcgggatccccctgccggtgatcgtacatgagtttctcgatatcggatacttcctcgtccgaatgtatcgccccggccgccctccctctcgggttacacggggttcgaaagtactccaggtctgcggaaacgggtgtagggatgaactcgcatatggacatttggccatgttccagcccgtcggggagcatgggcatcagtgtacctagaaaggggacagttctttgcggagctgttctctgtccgcgcgttgctgctttccgtagaaagtcatcggcttcggggtttataagggggggcgagccccgtgtcaaatgcaggctttggacagtgttccccatatccgtcgtagcgtttcgtaagagtaaaggggtacaagtggccgtataccccacgcccaaatcaacgttagctcgtggttgtgtcagagaaaactgcaccccccctgcgtgcgggcgcttcgagacagacacctgtccgagaaaaaacgattcggacgcccgttcggcaaacaggcccatatctgctaggaacctatcttgtcgtacgacggtaaatgcaattcccggatggaaccccgttctcaactgatgatacaggcctataggagtgagtttgaaatatcctgccatcagcgcgtacgacatttcgttgggcccgcatctactttcgcatatgtactgtgccacgggctggcggaacgtagaataataattggcgcccaaaaactgtggaacgggaggagctctgccgagcagcgtacgcgcgttcccggccaactccccgactgccgttagatggtcctgacaggcgaacaaagcgttaactggaacgggatagaagtacgtgccggcagcgatcgtctcatcattgcatgggtaggccatcattaaaagcccatggtgtaacgcgccatcgaacgttcgcatatgccttgtcgccgatgacgtgccgcctacatccggggtggttccgtagagaatcgccgttgtccgctccgccatattgttcaccgtttcctgcagagttagaagcgcgtccgcatccaccaatattctggcgttgtgtagcagcacgttaaacgtgttggggacaagatttctagcgttcaacgggtgcctcgggtcttctgcgcccaggggaggctcctcgtcgggttggatgtcgggaatgatcacagattgagacgtagcgtagatgttgtcgaaacggatgcccatggtgcaacactgacccctggaaaatgccgggaccatcacgtaataataaattttcgataggattgaccattcatgggtatgatgaggcgcgaacgtttgtcgatcggcgtctcctacaggcctgttatggactaaaacgttgccggtgcgttcaaaatccgcatcctgcaattccagccacggccgcacagcgtaattttcgtcgcttcccacgttcaaatacaagtttctatcgcgcacgccgtgcgcttgatacatcagggggtcacagtcccacagtagggggggtaggatcgctctatcgattaaggcgtggtttaattcctcattactctgcccggtcagtgagtctgtctgaacggtataatcctttacaatcgaccgcagcgcgcgaacgtgccgcatcagctctttgtagatattcgtacagtcctcagggagttcaccgctgcataaataggtatcgatgaatgcgaccatgtgaaagttattgacgaatgctactcgtttgcagttgtcccagtaactccgtatacattgaatgatcagtcgcatcagtataccgaaattacgttcgctgccgtgaattacggcttcgattacataaaacgcagtggggtagctaacgtctgagaacgttgcacatacggcattgattgtggaagcgctcattttgtggcgactggatgcgagctcttggccgagcgcatctctaaagtcgctactgcagagaggtagcggaatattacagttgcaaacccgccaggaggcggcgatcgacgccatcacttgcggaacgttatgcggccccgggagctctacatctcccgggaccacaaaaaagtcaaacgcgggatgcaactccatagatagatgtggatttccggccgataggaattgctcttgactcatatggcattcatctacccaccggggcgacccgcagagcacgtctccgatgttctcgaaaaaccgacggctagcttcccgtagaggcaaggccggcgggttcgtcacatacgccccgaaaacacacgttaaatcgcgtctgtcgcgacgtaaatgactaaccgtcgcttcgatatccaaaaaggatgagtggcacacggttccaatagcatccgataaacatacgctaattatctggttgtctttgttatggaaatatagctcccgtggcgggaacccgcgcacatctccttgacatccaggcccgggcgcatagtccccaatatgccgcgcataacggtccgcccgtttctgatatagtcccaaaggcatcacgaacgttaaatctatgtgtccgattaaagggtactggacttgcgttgcttgataaacgcgccgttccatggcttctagaaaaattaacttatccccaatggtcaccaattccgcaggcacttctgccgtttgggggacatcgtcgtctccccgtacgacttcatctgtacgatcgatgatgtcgttttcgtcgagattgagaatatagcgtgcgatgtcgtccatgttgcgtatggctttgcccatcactacggcggttactaggtttgttcccgatattatcatttctccatatgtaacgggcaccctagcagacgtatccgccatgtctagaattcctgatagcagtttttgcctcaccatgctcgttgttactagtacgccatctacgaggcgccctttcgaatcggaatgggtcagcctcggcattgcaattgtctgatgagtagagttaaccatcttggcgaggaatgagactatactgtctttgctcgcaccggctttgctcatgatgaaggtatcgttacacactctgcgtttgagctctgataccaaattcgctcgcattacctgcccgtttacccttccttctgtcgtgctgcgcgaaaggggtatcagtagcggagtcggcggagccttttccatcagtattctaagcatctgatcgaccgtgccccgctcaaacgaatccaatatcgttctcacgtttcgagctaattgctgtatggctctcagtctcaggtggttagatattgccgttccatctaaagatacttcagataataatgcgagtgcttccgccgcaacgacaaaggccgcgcttaacgatcgcttgcatacgcgctttaccatgtaagtgtaaagcggttgatcggcaggatggggcccctcgcgcgcaatcatgggttgctgtatttcaaattgcacggttccttcgcgcatgtatagcagatcgggagcacgcgtgcagacgcatgcgactgagagccccgtttcgagaaatctgatcaaagacaatgtattgcagtaggttccgagaagaatatcgaactgggccgaatagcgtccgttgtcatcggaactgaattgtttgaaatagtcgaacatgcatcgatgggatgtcatttctatagcagtcaggagtctacctgtaggcgctaacgttgctcctacgttgaatggtgtcgaaattgcacacggtgcgattggcggacagtcggtcgccggaggacagcggcatccggccatggtcgtcaacgggccgcgtccgatgtaaggactaattgccaccgtgactatccgatgctatgcgtgatccagggcatctagtaacgtttggtcgcgtcgaaggtcacgttaccggctgttcgaatgcgacgcaaatgatagccgatattgtaggagagacgtgacgtggagaatgcgcgagttctagcaacacgaacgaaattgcatattagactttaacgatgcaggtttttatctacacaatgaagtcgcgagtgcgcgtgcccttatatgtgcaagtttccgcccctaatcagaacggaacgcacgtctttatcagtgctcgtgtccacaaacgagggaggagaaatcccagtgcgtccgacacagctactgtagcgtaggtgatggtagctcccattaacaggtataccacagctccgtctgtcttatcgttttcctctaattgtaaaactttctccatgaatctcggatcttgaaacaccatgcggtaagaaaatactccgaatatcaccgcccccaacgtagacagaataccaacgaagatttgctggcagttatccataggcatgacatcattctttatgtttctgtacatgtaataagtttcgaggagtaaggtaccatagaacactgcggtaatggtcgcgcccaggatcagaaaacgattgtcgtgcccgtccatcgcgtacaccagaaatataatacaacacgagggtcggagaacaaatgcagatagccaagagagcacaacataccgagtaaatttggggttcatgtcacagcttttcgaaatagtgaaaattgaacctgataagtaagaggacatcgtggcatactcggccgcatcttcgcaatcgatatcgtccgaaacgcgtgtaactattgactccgtgtcttgcatattcgtctctaactgttcatcgccaatatagtcgaggagaatatcgcaatcggtcggttttgttgtatggtatccacgcctgtaccaaggcatagtgccactcgagaaggaccgtttctggccacacgtaacgactttgtcttctactaaagaccacccggactcggtacagacccaagctagagctcgagaccgcggaaaatggatatcaaatacgaacagaagatcttgtatagaaacgtccacttttatatctcggaatgcggccgcatagcttatttcttctgcggtggttgtctcatggcggtcgggcgaccgcctaccgatgactcgcaggcagagtttgcaaaatttgggctggctcttcgaggcgatggagagtctaaacccttggcagcttatgtacggcgggaattgcttcgtagaggaatgaaatgggcgctgcctcccggcgacgatgaattattcatcgactgtatggcctttttgaatctagacggggcgtgcagtgaacgtgagatttgcgatcttgtttgcctggaaacgtatgatccggagatcacaaaacacatggtatccacgaacgtcatttctggattgttgatccagacggcgcatgagtcgccgcgggactgcgtgatccacctgcccggggccccacaagttacagacgcacattccaatgctgtgtacgaatgtaattctggtgcattcgtgctaacttgcgcaactttggtggaactgcccacgtctctgaacgatctcgtcgaagggttgtttgacggtgtccccatccccagagatgcgctctcgtcgaggtcgcttagtagacgaacgaacgtgattatcacgtctaccaaagccgcggaaacgacgactatacagcggatgcatgtcccgcgacataaacagaggggcaacttaaacaccatcgcagctactttgcgaccggtgaaaaaacacgcgcggtttagcccgttcgtgcaagtaaagtatatacctcgcgtactcaaaatatggagttgtgattcagatagccattcgccgtccctaaaggagttgcgggaattgttttgtaaagtggacatggtccgtagagaaaacatgtacgcagaatcgcaattggaaccagagtccgtcacaagtgaactggttctgatagtcgatactgtatttgggagaccgctcgcaccatttattggcgtcgggtcggaaaacatacgcgtctcacatttccaaaagttcttactgctccagggcgtccttatattaaatcgtttgccgaattgctacggaccgcttcgggagctgtgcattcagcatgcacctgccggtgaagagtcgcctcctctggtatccgactctgttatcgcagacatggcgaaccatatgtttagggtcgccgtatttattggcatggttgtggaaatagttgcgggatgtgtatcttttgcatcagaagaactcgaaacgcgatttcccagtgcgaccgcgtttacggatgctggcattctactgaacggcatagaagcctcgccgaagccaaattgcttgtcggaacttaaaacacgcaaactcgctcttatcctggacggtatttatagagacatggatcctatagacgttgctctacaggaatcggtggggctaaatacagcagagttattatccgcagcaatagatatctcggttatgtctgcatttgagcattcgggatggtgtagcggctacatggaacactttgtttcattgctagatgcccgtctgagagagggagggtgcttggcaatattccggtagctttgtagcacagcggcgagacgcgcataggcgtgccgggcatatacagaacgtaagccaagctggagtttgtgtaagtatgtgctctacagcgtgcgggaagggcggttcgcgaataaacacaacagtacaggttcgacggttagaaagtttccagagtttattaattagattggcccctcaagatcgtctttgcgtcttaatttctcatatccatggtacctaaagttgctgacaagcattttggcggtgacaatcgctatagctgcggctattagtacacccgctgcagtagttgcgatgtaggtcgccgagaggatggcaatgcgctgcgactcaaacgctaggatcctcacgactgtgccatttggatacagcaatagtgacgtgccatacaggttactggtggtggggttgaaatagcgcacggacgaattgcctgctgctagcaattcccgctgcaaatcgcgcgatgagatataaatcgcatgtcgaacgtggccgcttgcggaatatcgcagcagcacgcagccgcaatacggacattcttttcccagaggcctaggtaaaaccgcaggactgattatacctgatgtcgacgtgcacggcagcctggcatatgttatgtaaagttggttgtttacatcaacgccgtctacggtatacacgatccctctgaccccggcccgccttgttacaatgtagctacctataccggagatgggtaacaccagaagagtgtcggattctaacctatcagtgcccgaacattccaaaacctccgacgcgtatgtagcaactgttctccctattgatgttcgcagctttgcaattactgattccgccttggcctgcagatcttcttcgattctgaccccctgagaagtattctctaaatactcctctattactggacggtaaaccacattggccatcgcgtataccctgtgacgccgctcggaaatgtcgatcctcaatgatgtcatgcacggcgtatacgcgtccaaaatatgtacgggctcagtgctgcgagtgagtctgatatacatgtcttgcaccgttaattcagcggccgcgatgtgttcttcagtacacatcgatgatgcaaataacagagatttgcgtgcgttatgcgatgcgcgccattccatcggcgaccgctgaaaaacgctgtcgaatgcataatacagggcgtgtctcgtggaagcattccacgagatcgcgtccctgacggattcttcgtggagagacgtgataaaatttagtgcgaggtcggaaattcgcgccccccattcgcccttctcccgaggtatgtcgaacgcgtacacggaccggaataggtacaactgtcgcgcaatacctaaagaatgcgtccccctcgatacatcgctaattttttttttcaatacggatgttagtatagcagctttttcattccatacatgtgtccgcgataataagaagcacgtgccggggtccgtgctcggggcaaaattgcaaagtgccgcggcgattactttcagatctgcctcccttttaattaattcatcgagggagacgtagccagacttaaaagcggcgtgtacggacgcaacaagcgccagaaacaaacgcgtcgttacgatcctaaagccgtggatataattactagtagatgcgggcatagaggcagaaataaaaagccgggagtgcgcttgagtgatatgaagattataatctaataggtcatctacactcgaaaccatatctgcgtgggcctttaattccatatccgaggcgttctgatatgttcccagtaggtatgtcgaaaggagatgtcgagaggatccgttcatcgggtcatactgcttcatcggtggccacagcaaagtcatgttggtagtccccgacgataatattagttccacaggcgatgcggcttccatagagatcgtaacggaggcgaattgcactcctaccttcattaagacctccgcggtatttgaaccgaatatcgtcgtccgcacgtgggcataatctgtcgggactagtgtgtccatggggtccacgaagcatgcacgctttgcaaaagctcccgataattcgctgttgagaataaaacggttctccggagtgaagaagtcattcggctttatattttctaacactgttggcgggtttgcgccagtaggttgtgacttggcaccaccgtgagcttttggaccgggtttgtccggtgtctttttttcgtctcgtcgatgggataatacggctgccgtcaacgagtaatcgaggtccggcttcgcgttcaaaactttgatcaggttattagacgttagcagcctagatatcggtcgtttgaagaaaaccatttgcttcacttcacttattggtaaatgaaagagaatgccgctcgccggcgtagatgctcctatatatacaaatgtcgcattgtcgcgtacccaggacgtcgggctagtagcattttcatcggccgatgaaaagtccaattttacggacggcggtctccggatgtctagcagcgaccatacggaggggatattatccgaggtgggggctcccggggaagatgcgagcgctagcagtaataaggtgcataccgccattccgattacgcggcgtcggtcgttgcctctgcgtatcgctagttcgagctcgggtttccgaagcaacgtaacacacatatcctatagtgtacaatgtttcgatgcaactgaaagcaacgagctaaagcgaagatgttttgcaggcgacaagggcatgcattaatgcacactcgtccgaaatgtcgtagtctcaaatgtccatctccttattgaatgcctgaacgtccgcctcgatctcaaatacatcattccagctcatatgcgttattaatctttccgccattgaatccataagatactctgcacatttctggaccgacatgtcgctgacatcaagccgctcgacattgatgttcctcagtttcatcaacatcccccacaatatccacccgtataccgttaacaggctaccatcttcactgcataattctttccgcttaaaaattggcaaaagcgtgtgctgcaatgacacccggctaccatggtaacctgaacggggaccatctataaatgtagaggccatcgatgcatcaaaccacgggagctgcatccactctgtttcccattcgtctttactgtaaggacaaatgcaattcgcatacgcgacggtatctgctaaagccgaatatgccgcattgagcgccctgagcatgcgcacgtctgtagtttcccccgctctgttcctggccgataggcgcttcaggtgctcggtttcgtcgggcaaatgtgctattaccaagttgcagccgggcggttcgtggggcaaccgtgtaatcgcactaatcaacatttccagagaacaatcgccaatcagatgtcgggcgatgggaaagcagacggtagctgaaacaggatggcgatcaactattaatataagagatgggttgccccgtgttccggctaattgatgacatttagatgatattcgttcgtgtagtacaatgaagggatcggcaaatttggcctgcaaagccattacgatcatgctagactgaaatagagataattctccccgacgccggcgttcggaagcgtcattcacagctgcaactaaatcggtaaaatagcgacgccaatatttcagaggctcaaaaactttcagcacgggtactcccgtcgcagagtggctcggcacttcgtttaacatcgacgttttacctatagccaatggcccgtcgaggtagacgcggatcagctgcgcggatgtcatctgagagggcattaccgaccacggccgcacgtccgacatgtccggcgcgcaagaaaactgctcgtagacgatataaccggcggagaagcacttctggacgctcaagttaccgtgcggctgttaacctcaagagaactctagcggccggcgttcgatgtcacgcacgtttttaccaaaagctctacgcagaatctatgcaccttcgaactcaggccgatgattggacggggcgggccctatctaagattttaggaaaaattatggggtttgatgtatttaaagcggcaactgatttccgattggtctttgaagtaaatctggggcggcgaaaaccggactgcatttgcatgattaggtgcccccgcggtctatgggaggcaagttgtgatggcgcttgcgtcatcattgagttgaagacttgtaggttctccaataatctaggaacggccagcaaaaaggaacagcgcctcactggaacaaaacagctcttggattcaaaattgctgattgactatttagcgcccgtaggttcggagcgtattttcatctgcccgttactagtattcgtgtccaggagaaaattaaacgtgttgcgtgtaacctgcctcagaagaaacgtcgtaagtaccgatttccatcgtctcgcaactttaataacgcttgcatcggaatataagattaaacaggtcgacaggcgcagaacggctgttcggaaaccggctcagtgtgcaagaaatttcgcaagtcttgagaacgcgcggcgagacgatcgatcggaagaggtcgagatacacacttttcctaactgtagtattgtcctaccacctcgtaccattctacccggagccgcgaatacgacaatgcaccgtttggcaagtattgttagctgcttggtacggaagcagtaaccgaaatcaacggcaccctacgaccagctatgttacacggtgcaatccgcggcccttctcccgttactttcttgctccgcagcccttgtccaacgtcagttgtccgtaggcactgcagcaaagcatggcgagctttgcctgggatgcaagaattttgacagacccgggcccggaatctcacccggctgatgtaaagaatttcatagcacctccctggcctctgcacttctggagggaacctatatttagcggcaatcttggggatgcggaacggcaactggcaatcgttaaggcgcgaaacagtgccgcgattgcagcgttaactagtttggacgaccgtactgatttaattgcggtagaagtggagcgtcggcttcgaccactagaagataaaatggaacagatcgcaacgactttggcggatttggaacgagctgcttctgcggctgaacttgccgacgccgcagccgatgaggctcaaaatgtcgtcgattcgaacgaatgccaaaaaaacattggtagcgctgcgagtcgcgaggtccaaatagtcaggaacgatccgtcgctaagatacgactctaacctgtcggtggatctgctgaatattatctatgccagcaggggcgctgcgaattcgggagtggcgttcggtacatggtaccgtactttacaaaactcccttattgcggaaaatcccagcgctgcgcggaagatagattatcgcgatggaagaatgtcgcggaccttcattgcaacggcgataacgtccttacagtcatgtgggcgcttatatgtggggacgcgtaactattcttctttagaatctgcagttctatgtctgtatgcgttttatacaaaaacgggagctaatgtgtcccatccaagttcttttaagagtgcattagaatctgttcccatttatctggatcacatgtcagcgagcctcgctagcactgataccaggcaaatctacgggttcgataccgggaaattgccgaaggatagtttcgccgccccgtccggaaaatacgaacggggcgcgctaagtgatcatagcgtattgagagctctagcaaattctcgcgtgttgcctcctagtgcggggtcgatcccccgtggagacgtagccccagagctagatgccgaccagagcgttcgtaacgacgaagtcaacgctgccgccgcagcgctactgggacgagcccaacccctcttccttatggaggatcagacgttgctgagagccactttggacacaatcgtggcattgcttttacttcgccgtctactttggaatacgaatatatattcagctagagttaaaaaccagttccaactgggggcgttcgttccaggcgtgcctccagatttaaccgtaggagcctcagtagacacgccgggggatgtaattaagagtgacgggagaaacttaacctttttatttcagagatacgtagttcccgtatatagtgttgtcaaagggatagagctcacacaactctttccggggctggtagcgttgtgtttggacgtcccgttttccgatcgagggttatatagcaccaggacgccgccatcgcgtatcattgacgtttcgctgagtaaatatcaggcctccctcgtgaaattgatttccttagagcttcaaaatcgttcccgcgctaatgttgtatctgtttgcgaggtgatcgcgactcacgatttggtgactctgcagtatgagcgaggcttggaatcgctgatgcaagtccagcgtccccgcacccgcttttttgaaaccaagaaggctttggcgttcaatgtggaaacggattacgatctgctttatttcgtgtgtttagggtatattccgaggtccgtatctgcatcgtgaaatatacgcaaaatattggcacgtgtccagcttaaacaacagtttagtagaaatgaatccgacggagaaatattcctcggtatatgtcgccggatatttgtttttgtacggtgcagatgatggcagcgaactgcacatcgaccgcgaggatattcgagctgcaattccgacacctgctcctttgcccataaacatagatcatatacggaactgtaccgtcggagccgttctggcactaacggacgacgaacacgggctgttctttttaggaaaaataaattgcccggtgatgatacgcacgctcgagacggccgctagtcaggaaatattcagcgaattcgataatctcaaaacagaggagagggtattgtatttgataacgaactatctaccatcggtgtcgttatcttccaaacgtcttgaacccggggaaaaggccgacaaaagttttctggcacacgtagctttgtgtttattggggaaacgaatcgggactatcgttacatacgatcttactccggaaaatgccattgaaccgttcaggaagctttcccctactaccaagacggccctactatccgaggggcaagaaacagagcggctcttaggcgataaggtctggcatcctagtaaagaggcgatgtcaaccgcgttgttgggcaccgctctgaacaatatgttattaagagatagatggcgcactatttccagccgaagacgcatggctggtatatccggccagaagtacttgcaggcgtcagccttgaccgcactggccgagtcgatgacgtccaataacgcatcaacgatccatccaatcggcgaaaccgcaaactcggacggcatacaaaaggatgatcgaattgaagtgtgcgccacttcgccgcaaacgaacaaaaccttagagtccagagcattttcgggagggagtgggttcgccgggactcatgcgatctctccaccgccccagatgagcgcacaatcgccaaccgagatgtctatgaatactaaatctcatttcccccccggcgacgatttcatttgggttcctatgaaaagctacaacgaactggtgtcgagacaggccacgcacgcaattaatgcccccgaagctgcagtggggagccaggcaccgtatagttcctctccgttaatgattccggcgcacttgggacagcatgctcacattgggggatatggacatgcctccaacccgcaatttgcatcgggggccataaattacatgggcgggtttccatatgctctgcctatccaccccgttccaaccggccaatcgtctttggaaaccaagctgtcggctctactggattgtatgacgagggagaaaaaatcagtcgatggggatcgcggacgtgacgacatgttctctggccaagaagaacgaggccggcgcgggcgcaagcgcccgtacaactgtgacaaatctcccgagcaggaaccttattatccaggcgaattccagcagtccgagcatcgtaacttaagatgcgaagacggcatcgaatacgggcgagacgcgactcaaacgaggcccgccctggcgggcctcgtgaacgctgttacgtctttgcagaaagaagttgaacggttaaacggaagggcgcaagcccattcgataccggccgtacagcatatgcaaggaatgggaaccggattccaggcccccgtatactacgcataccctcctctcccaataccacatgtattttcgcggccgccagaagacggccgcccaatttcttccggggagggaagggcctcgctaggtagcgccacgggcactcctccgtctggatcggtacctccgaacgcttctcaagaacgtgtcgatgcagctcctaaaagcgacaccgttcagtcgcaagatactgtgaacgccagtacgatcgccaatgtacatcgcgccgacgatgcaggcgcggatattttcattaaacaaatgatggcttaaatgatggcaggggatccgctatgtcgacgtataagtttatacattttgcgaccgcaatagcaaataaaagtaaaataatcgtatgcgcacgtgagaatttatttatcgagaaacagcatcgcgctaaacggcatcgtcctccgaatcagagtacacaggcgataatctatcgtagtgctggccactactttttagcctcagctttgttaggtgattagaaagaatagcagtggtgcctcttgtttttttgcgcaaatcattttcgtggcgttcctctgcggacaccaacgccatatattttatcatttctcgagccttctgtaatttttttttatcgattggtgccttttccgagtccggttcttctccgtgcaactcgcgcgttgcctgggactttagctcttccgtcgtcactggatatagggctttcatcgggttgcctctaagcttgtttacgtaccagtaagctagaaacgcagccacgagtcctgctataattatcaatcctaccgctaaagctccgaacgggttagacataaaagcggacactccagatacggtagccaccacggcaccggcggcacccacaacgaccttccctatggcctgaccgacttgccccataccgttgaacaattccgccaggccgttcataaaagcgtaatttgtatctacttctattactttatttatgtcataaaattttagttcgtgcaactggttgcggcgagccacctcggcatagtccaataccccgacatctcgcaactcctctttcgtgtagaccgacagaggaagaatttctctgtcttctaacagtgttaagttcaggtctacaaacgtgctggctgtctgtatatcagcaacctctaccatcttaacaaagttatagtcttcgaacagagcgtatgcggatccaaacaggaagtatctccgctggttagccgtacacggttctacggcctccagtgttgggagtagctcgttattttcgccgagctggccttgtatcctcccctggttctcgccatacgaaaacaagaccagcgggcggctgtagcacatattagtagacgtggcgaccctcatggaattctgcaatgttaccgattccgcgtcgatcccagtacaagtagacacggcggtcacatcccctaacattttagccgctacgcgtctccctaaggtagcgctcgcgatggcgctcgggttaattttcatcccttcctgccataaagccagttctttattttgtaattcgcaccaggccgtggcgattcggctgaacatgtcgttgatatgagtctgtatatggtcgtagagaaattggagcatggcgaattggacggacgaagtagatcttatcgtagcgccttcgttcagcgccagtttttccttcggcgcattacggagctctcgccgcaaacgggacaaggagacatttgttttattggaaagagcatgcttattatgtactaggtctagcagctcgtctgtcctgttgtccctcatcagttctcttagatacatgtgagccagagatttcgacataacgggctgatacgccacaagaaatccaccgagggccaaaaaatattggaccttcccgaccttgacgtggctgtcgttatatttttgcgcgaatatgcgcttgattgttgtttcagcgtcgcgctttacgcactgacctagcctgatacgatccggatcgaattcagtggtattgctgataaatgttgacgatagctcgcgggccatgaatctatacttgccgttaaccgttgcgcgcaacatttcagtaacatctttccatttaaccatcgagcatacacgagcggtctttgctgcccagtcccacccaaccgtaaaatgtggagtgacgaggaagttacgcttgacgggtatgctcgccttctgacgcttgctcagatccattgggaaatagccgtctatctgcctaaattgttctagcggatagcccatgggttcggcggcggcctcgggcggggcgacgccataaaacggggacatatttgcgatatctccgttcgccattgcaaaatacgagtatgggaatgcagccctggcatccatttcttccactatgcagttgacagacgtccccgtccgatatacccacggagacccccatacggtataagtgtcgttggtcgtatgccacgccttggactcgggggtgttgaattttgacggttgtagaagtacctgtttttctccggcgtcgccgtcgtatgcctcgacgtatacattgtttctcaggtatcgcgctttggaggaacatctccctttcgcgtcgattacatccgtaatttcttcgatggaaacgggagtcctatctgtaaacctgttggtgatttgtctgtacgtcgtcccggtccaggtcgtcgtttgtataacgttcttataataaagcgtgactttgaatttgtatgggtttatattctctttgaagagtatagcaattccttctccccattcggtggcctttagcggttcggggcattttcgcggcggttctaaccggaccacggtcgtaccgaccgccggtgggcagagaaaaaatgaggactcgtcttcagacagctgtacgctcgagactgcttcccgcgacgttacgttttgggccctcgcgactcggccgaagaagtagaaaaccacagatatgaaaagtggaacgcagatcccactgaaatggttcattacgggttgatcttaacgagtctcatcgatagtgtggaaaggcgcgccgcggtacgaaagatatcgcactggtcaagtgggggtgtggtcatggtttgttcgttccgcacgtatctgatccgcagccgcgggagccatgtactgcagaatggaatagagcagcgagaaaacatccgcatcaaggattacggtcacgttgtctgattccgcaccgaggaccgttatgagagggcattctgtttcatatgtgacgtatattccatcctcccatatgtattccacgttaacattgagcggcaagcaatctgcacgacgcaggtgcaattcaccgcagctgaacgcggaagaaaataaagttgtcgccaaaatcacctcttttatatatttccaagccattctatgggccgcggttatactatctatgccgtcgaagtcgtaaaaccctctgaatttactgacgatccagtcagacgaactgcaactatgaatcataaatcgcgctatttcctccttcaaatgcggcaatagaccaacgttctctacactgaaatatagcgctgtattcgaaggttgggcgaacctatgtacatcgtgattaaacatcgggccgtttaacaaccgaaaaaatttgtgagttaggctggggagcatcgcgggatctattctgtgcttaagtaatgacgtttgcatgaaacggtgggcgtcgaacgcatcagcggtgatgcgattatcgatgatattcgtacatcgtttcctaatggcttccaataacctattcctggagcggaacccattgaataatgtcgtgtatgagtctatcaatatttcaccgtatacgttaacccgcagcattttttccagctcctttctttgctctgtaatacatttatccaaacttgcgagggatcttttacttaggcgctctgcgtacattttgcgtctccgagcaacgtcagccgatgccgatcgtaccaactctaaccagtcgtagtgctcgcggacatcgggtaacggggtaaccccttcgcgaatccgtagatgctcggagttactaaaatcgtcctcgggcgcgccgtcgccgtcctggcataggggaccatttctcgtgctatgcgaagtcacttgttctaaagtagtcttcagcgcgtcttgcgccgcctcctccgggtacaataaacgttttagcagaggagtcgacatatgatgatcgtaacatgctcttatcagcgcttctatgatgtcgtctggcgctaccgccctaccccccagaagcaatctgtcggccgcattcatattctcgatttcttgtgcaaacacccgttcgaaatgatccatgcgccgcccgaataccgtcatttccacgacggatgttctcagatcgaaaagacgctctttgaatgctaaatcttcgaggttgtccgcaaacgagtcaatcgtgtttgctctcggttggttaggtttgcgttcggacgaggcaatccagaattgcagctcgctaatggcatacagattccccgatgccggcaaaaaaacgttatgcgcgtccaggacggcggttgccgcatcggcgacagacactgtatcgccgctacctccgggatccttgtctccccttgtcggtctaatgagcgaaagtgccgcttgtacaaccgaacgcttttcgtcggacagacaagcggcatgtgggatgtgcgctaccatgtcatctgggtggacgcggagaacgatctgcttagttacatgattacatatttttccgattatgcgcttatgtgccgagtctccactgtttgccgtcacgcatagttcttcaaaacaaacggagcatggttgtgacgggtcgcacaactccggcgaaacgaccgatcccgcgcccagagtttcgattagatatcgatccagggccaacataaagttttctgcggttcccgcttttacgattaggtgacagtaattgagttgcttcaatatgttttctacgtcgtgtaggaatttaatctcggtccgcaccgaaccgccgtaagtatccaattcgacgacttcgtgatacggacagtccccggatatggtcatcgacttaataaaaaagccgtgtacatctccggtgtctgtaaactcgcacagcgcacgcagcagcacttctccgtctagtcgagctctacgcagagctaaccacaaaccgtagctaaggggactaatattcctctcgagttgctccgtcagcccaggagccattaggttttccaaatagcgtaccatgagcacatttaatttcagcggcttgatcattcgcacacctactctcggatcgcatctcttcagcagctctacttgaaacaagtacgattgcaactgaccccatacagcgagcagtttctgactagcgaatatactgtctcgctcaacgtctagcgcttgtgcgtttccgtgaggcatatccaacgtctcggttcgcctcgtctacgctgaattggacctgagtcggagggagagcatgatgatatttataggggttagccgataacgccccatccggaataagacccacaaagcgatataagaaagagtatgctgtatatttcatatttccgtatacaggttgaaaagccgacaatgacgtagtatctatcttgataaggctatgcgagcaggccccatccgggatatgagctaggtagttcgatacaaaagtaaacgcgtttagacccaaacacagattttaaaagcccgcaacccacgtactgggacaacaatacacgcggttatagcatatccaccgatagtcctggagcccgcttttcgggaacgggctccaagtcaaaaacgtccgaacacggacgtttcaaagttggctctaatatggacgggccgtccgcgcgtctttccgtattctcatcaagagcatcgtaattaaacgtaggtccgtccagcgggagagccttcgacatatcgaccatctctttcgctaatatcgcggcagcatcgacactccaaccgccctcgcatccctctacctgcttgttaagttcatctatcaaagatgagatgtacgcatcgttagttatttccatccagtcatccagttccatttgccgtacacgatctccaaccattttcaacgcgatcatatatacggcggcatgaggcgctccgcactcctcagataaaaccgcccgggctctatccacgagcgtggtttccttcaagcccgaggaaaatccagtctgttccgatacaaagccgaccctaggacatgccatgacgaaacggtgggttctattaaaagacattatggagcagacgtttctcccacccattatgttgccccagttgccggattggaatacttttgtgctaccggccattccgtgatatttactgatgctgacggctatcacaacaaagggtttagaggccatgataggaccgacgagattagtagatgaaaaggcagcacaccatgcttccttatgatcacagatattttttagcagttgctgggcggctggtgccacatctgacccttgtgtgaggatatgttcgatccagggcaggaccatagccggatccctaggtcgcttggaggttgcaaccaaagccgaaatcgtgttgataaagaaatgcttatgtgaacagtacctcaggatggtattcgctagataaaattgagccagctccccgaagcatgtaggactgatgttaatgtaattcatatcggcgtagctattggtaaaccttttaatgaatgacgtgttctcctcggcatctttggagagtataccggccggcaactgattgcgttgtaagaggatccaaaaccagagagcattgggagtcgtgccattaggcatcttaacattcggaaaaagttgcgtgtgataccgtttgagcgcaaagccgagagggccattgagcacatgcatcgcttttgccggccgttgatacgcttctatcatgcccgccagccgggattttgtagcgtcggagacggtactggaaacgcctccgacgaacataactttattcttcactttaaattcccggaatatctcaaatgtaactttcactagatctccttccatgtgcaccgccagcggatcatgctgagatttgctaggatcgggaacggagatttgttgatcctctaaggtcaccgttatgtttttagatgtgatgaacccggcgttttgcaagtccagtacgcgccgcctgagtaccgcttggaactgagtcctaaaatttctagcctctacttgttgcccgtgcattatcatagagcactggcttaacgccatatcttgaacgacggcaattatcgtgcgcctggataaaaatgagagcacgggacatatgcctgacgaatacggctctattgccagcgaaagggtatgggttgcatcacctagcccttcgcgtatgttatattctctgatttctgtcaaatttcgcatcagctggccagcttcgctctcgattatattagccattgtcgatagagcacgcataaacgatttgccatcccggatgatggcatctgcgggtgtcatgtctgctgggtcctcgcatgtcagcaaaccttctttttctaacgctttcattactctttcgaccgtcagcttgtacgtgtcctgcattacactgcggctcgtctctccctccgatcgtttgagagtcgagaatggggcgtagcttcccagcgcgttcacgtcgcagtagttattcgtcatagatccaaagagccccatagccccacgcatctgatacccgaatttcggcaatcgatattctaagcgcttaattgtggtatgggcgcaataaatacgcgacgctttgtcgcacaaatcgcatggtacgtccgcgtccatggcagatgaaacaaatttcacggtatctaaatcgtgatggcaagcttgagatccgccgtcacacctctccaggtagaacaagaatcttgccagcaattgcggacaaaacccacacgccaaaattaggtaatctaacgagtattccgacgggctggccgatgtggctttggacaaatcttcgcccggaatcggcttgccgtctctatcgattaacgggtttgaggccaaatgcggcgcggctatttggaaaaaccgataaaacgaggctgcggtcgtacttgtgtcttttccgtctgcgctactcgcttctcccacctcggtcatgtatataaccgaattcgaactaaacaccattgccccgaccagtcctgccacgcgggccatatacgcagacagcgcttccactctatctgtatatccgatcggactgcaatagaggggccatttctttacatcgggtatagactcctcgtagaccgatgtcgcgattacgttttctatggacagagtagcgtcggatgccattagagaagccgtcctacgttcataccccccgccagatagctccatgccttcctttttccccgctttatactgcgatttcgaagcagattcgatgggagtgaatgcgttaaaagctgtatctgcgggtaacaatgttccctcgtgattttcgtcaaagcttaaatgggcggcacagcgcgcaatcgcgtctacattgcgaacgcgaaggcctacggccgcggtactgagcacataaccgtgtaatagacgacataaggaatcattatagaaagcctttggcataagagctccctcgcctagtgctctaggcttcgtactaaatggatcgctggcaacgcggttgaagtccgggaaaaccaagtgcaggggatataacggtattctacgaacatcgacgccattaatgctcacgactccagtaccaccgtaatgtaaatatgagttgcagaggtacacggcctctttaaataattcggtcactactaagtagagcatagtttcttgaggattcattccgagattatcgcatatttgctcgccggttgtttcgaacgacgtggctaccgggggcgaataggtgctgtagccgaatcttcctcgtgccaaatcacatgctttagtcagattcggagccttcgtgcacggttttatacattctccgccgtgaaacacaaacacgcacggatggtaatgcgtcggaacgagcttgagagtagttgatccgctacccagacccgttgtcttcgttcctgcaacagctgccacgttccacatgaaatccgcttcaactgtaagacctgaaacgagaggcaatatcgcatcctcgcagtcattgctcttggccgcgaagatcgagagatcttcagctggcatgctgctcgtgggtgcagcatatacatatcctatcggccccccggtgatcttaacgcttttccctacatccatggttaaggtgtcagcgtttatccggtagactgtacaacggaatggcaaggggcgatgtgccttccaaagctgcgaacgccggcttcgccaggagatggcactttgactttctcgtgccggatgttttaaagccagaggacctccaaaggatatgacgcaacacttcctaaagtgcgccacgaaacacgtcgcgcatattgtatgttttataagtcctcgacttcaaacttgccttctctgtaagccgatatgtcagtagatggggctagaacttttttcaacccgtacctcggtgcacgaaagaggggacgggatgaagatagtaccataccgccgctaagtagaccgcgggacggggagagataccttcggcaacatcgcaatgcgattacctatatagcgactatagacgaatttaaatatatcgcccccaaatgcttagacgcggcggaaataaagcagcggggcactcatatcggcaaattgaaacgctcgcctatactgtacaaaaacggagaggaacgtgagttcttgaatttcgaggctttgggggacgcgtggccacggagatgttttagctggaataacgtatcattcttacccacggaattcgacccgcgtttttctaggtttcatgtgtacgatatgattgaaacggtagagtttgcaaatggggcaacaggcagagataaaaaccgttttctggagctattgcggcctatgggcacgattattaccatgatgggaatgactgaatgcggcaggcgcgtggctgtgcatgtctacggcgtcaaaccatacttctatatgcgtaagatcgatgtagacaccgcctgcgggagtcgatccacccgcggactcgctgagcagatggcgagcgtggtacgctcgtctgtgaacgaaagcgcaagaaaacgattttacggctcaagcactgtgacggccgactgtttcgaagtggacgtggtacgtcgtaaggatatttatttctacgggacagattgcgaagagtattaccggattaggtgtcagagcggcaaattcgttgcgctcatatgtgataactttcacccctccataattaaatacgaaggcagtgtcgatacaattactcgaatggtgctggacaacgccggatttagtacatttggatggtattccctaaaaattgggaattgcggtgagaaagtacaagttcgagcgccccagcaccatgttacttcatgcgacatcgaaattaattgtacggtggacaatttgattggtcatccagaggacgatcactggcccgattacaagctcctatgctttgatatcgaatgcaaatccgggggagcgaacgaatgcgcatttccggtggccacgaacgaggaggatgtagtcattcagatctcgtgtctgatgtattcggttcgacaaaagcaattagaacatgcgctgttgtttgccctcggttcatgtgatcttcccgaaaccttccaagagacgtttcgtgatacctatggcgttttgcccgaagtcctcgaattcgacagtgaattcgaactgctgttggcgttcatgacttttgtcaagcagtacgccccggaattcgtaacggggtataatatagtcaatttcgattgggcgttcatagtgaataagttgaccaccgtttacggtattagattggacggatacggggttattaaccaaagagggacgttcaaagtatgggatgccggggcaaacgcatttcaaaaaaaagggaaatttaaggccaccggaataatcgctttagatatgtattgcatagccaccgagaagttgaagctgcaaagttacaagttagacgtggtggcggaagccgcgttgggggagcggaaaaaggagctgtcgtataaagaaataccaacgcactttgcggcaggtcccagccaacgtggaattataggagaatactgttttcaggattcgttgttggtagggaaattatttttcaaatacgttcctcatttggaactgtcagcgatagcaaaattagccgggatattgctatcgcgagcggtattcgatggccagcaaatacgcgtgtacacgtgcttactacggttggcgggctcgcgaaatttcattctgccgaataagccgcaggtgcgtgcgggaaccgagttcgaaaacagcatcgccagtacggatgaatttgaaggcgaaccttccccttcgaatccaaaggcatcctcatcatttcatggaaatggcggcagagtcgtcggttaccaaggagcgaaagtgttagatcccatttcgggattccacgtcgaccccgtggtagtctttgattttgccagcttgtatcctagcataattcaggcacataacctgtgtttcaccaccctaataaacgacgacagaaaactcgccgatctacgtccacgcgatgattatatggaaatcgacgtacaaggaaaatcgctgcattttgccaaaccccatattcgagaaagtttactgggtatcctattaaaggactggttggccatgagaaaagcgatccgagctaaaatccccgctagctctgatgatacagctgttcttttggataagcagcaggcagccatcaaagtggtctgcaattccgtgtacgggttttgcggtgtggcaaacgggctattaccttgcattgatgtggccgcgaccgtgaccacaattggtcgtgacatgttgcttacagtacgtgactacgttaaggttaagtggggaaccagagatgccctcctccgcgaatttcccgcgctgacgaattatatgttgggcgacgattactccgtgagcgtgatttacggtgataccgattcggtgttcattaagttcaaaggggtagcgatacagggcctcgtcgcaaatggagacgatatggcaaaacgcatatcgtccgatttatttcccaaacctatcaagttggagtgtgaaaagacattcgacaagctgttgcttataacgaaaaagaaatacatggggacgattcacggtgggaggatgttaatgaagggagtggacattgttcgaaagaataattgccgcttcattaacacatacgcaaaaaagttaagtgatttgctatttcaggacgatgcggtggcaaaagcagccgccctcgtcgcggaaaggccttcgtcattttgggcaacggctcccctaccagaaggcttgaagcccttcggggacatattggctgaggcatacggtcaaatgacggcaagcacgttgtccgacgtgggagatttcgtcatgtcggccgaactaagtcggccaccgcaggcctacgctaacaaaagaatagctcatctcaccgtgtatcacaaattggccatgcggtccgaacagttgcccatggtaaaagaccggatttcctatgtcatagctgccgcaacgccggaggtactgcgcgatgccgagcgggtagcagaagccagaggggaaaggaaattccgctttagcgaggtctctgtcccggaggttccagggacgtttagcaacagcgccaagacgcgggccgtccaaaaacccaaggtattgatctctgacatggcggaagacccgacatatctaatcgaaaacaatattcccctcaacacagattattatctatcacatctattaggaactctatgtgtaattttcaaggctttattcggcaatgacaccaaaacaacggatactgtattaaagcgatttattcccgaaacttatacagaggatcgcgcctacgcgacgcgagttgcgcgcgccgtctttgcggagatacgcagcggggccggtctaagttctagcgaggaggaagaaactcttcaaagactgaatagagctttccgtattctaacagaagttcgccgtcgatattaatgtcgcatagcttacagtacacgtcgtcggcgttgacggctgggacatcactcgaatctgtttgacgatcgtattcttttctaatgactaataaaaagttaccgcgccacacgtgagcgattatgctgtaattcttacaggccgtttttaaacaatcaatcaatttgtagtggaggtggagagctttcccggggaacacgacatacatcatgtattcaagggagcctgcttcctgatccaagtaaaacaacaccttcacatttttcattccagaatcgagtagcacatagtatgcgaaaaaaagttccgggattgccaaaatacgagaaagggcaatttcgctatctttcccccgctcctctccgcaccccattctgccgcccaaggccacgatagaagccatgaaattcctataatgataaatgttgtttatctgttggacatatgccaatatcaaagaggcacgatcgtttcgccccaatcgcgggtctccgctagccgtgcacgtagggcaacagccaccaactccgagataataccccattcccgacaaagacaaacagttatctgcgacagcttccgacatattgaacggcaacgagactggcgttgtcttgatgatcggcacagccaaatccttgactaccattagttcctccgatggggactcttcaacgaaatcgaagtaagcgcgatacaaatcgacatctggttttcgagacccgcgtttcgtaccgcatgccggcgcttgtagatctcgccattgccgccgcgaccgtcttgctatccctccgctacgccctacagatctgcgtcgtatgaaaatgcaaccggtcatgccgggaattacgatgtcacacgtaggtttgtagcgtgtgctcgagagatatcagggatatagagtgtctttgaagaaatgcgccagcgtctttgacgaacgcggataaagtagtcggccggggagggaaaacctgatatgtcttgaacgtgtacgccaaggcccaaaacccggcgcatacgcgaccttcgaaacggttatggcttgcgagccgagctttatggagtgccaattcttcccggctcgctaggtccgggtggtcgaacaatgaccgtggattggtctgcgctatccgcgcagcacacatcgggtcgcaaaagaagtgtttgtagattgcttccgttcccgtgcctttgagcagcgccacgaagtatccgtcatcttcaaaatcggcatttctctcctgcgtcccccacgcctccaacaccggttctatgctatggaaaatgccgatgttgttagctgaataggcaatgatatcgcgcttaaattgccgcattgcaagccagtacgtgcggattagtaggaagttgcacaataagcattccgcggacgttccccctttggttatcgcgtgctttaattgtgttaccattaagggtcctaactccaaatcaggttctgagtcatcttcgtaacagtgactatatgcccgagtcgcccctctagcaagatctattctgttgtctttccaaaacttgctgaccgtctccttcctaaatttcgctgccataagagcgagttcgctcgccccatctggtgcagatcccgtgcccgaaagcaataataggacgagattcgtataacccatagtagagtcctcgccgctcgaccgttccgtatactgagaccgattagtgcacggtgctagtgcaccaagatcgttctccccgtcaggcagtgctttgctcaaacgaagctgcaattcgcgctcgtaaatatcgtcgtccgacaatgcgcgtataatgcaactttccgtttgagaaaaattacattctacgcttctcgcgcagtccttccagcctgccaaagcgacggaaagcgaggtgggaattgagccgaccgtttgacccgtttgtgggactttccttttactttcgtgtccagctgccgtgtcgcattggccctcgtacgacgagtgacccatgtcggacaccgtcgtcaacatggcccgcgtagcgctttgggccaaatacgaatagttactgtacaacactttagcgtcacccgcgcacagcgaccgtcctcttttccccgccgaacggccttgatttgcacggggcacgataacctcgttatgccgtcttcccggtacccccccgtcagttcgaaaacaaccatgcagaaagaagtgtctctggatatcctcaaaagttaaatgctttctcccaaacgagcctaccaacgtgcaaccgtgatcgaccagaaaatgcttatccattatatacacgaattcgaacgctgctataaacattgttgtagcgcatggtggagaaccaagacatttggaacacaaaaatgcgtaatcggccatccatatagccgataatccgaatttgtgcttatatatatctaaaacacggcaaacgagacattgtctatctagagcaaaaacctcggctgccgtcccgataaacgtcgccagctcttgatgctcgattccgtcttcgcaatcttctgcgctttcgctaccactgcaactctgaccagcctgaagactgttggtcttaatagcgtgggcggagagtagcaattcgttaaagagcgtatcgttgtacgtcaatatttcaggatcgaacgctatgtaagggcattttaaggactcctcgacccatccttccgacgcggatgctcccggagatcgaataaacggtagttcgacagtacgatgggccatggccgctgagacaaacactcggcaagtagatacgcctcggttagccgacgcgatcccagacgtagagttgctgtcggacgatgtcgataaattagctgaacgctatatttgcgacgggatcgtatatcgcgtatggttcgaatacctaatacccgatgaattagatttgattttcccgacaaccgacgggaagtttaattatctatcattcactagaagacttgcttctgccatccgacatggtcgtgccggagctgggagtgcgacccctacgtcgtttatcagtgccgagcgtgtctgtgaccatggggccgttttgagagggcggagcgagagatttgcatccgtaattaataggttccttgacttgcatcaaattctgaaggattgttagaaactagcaagccgaacataattgctccgccgtatatctttttttcttttacgaaggcatacagcgaatgatgagcgcgcctcagagtaagccctgtcgtcgtgcaggactaatagcacggatcaggctcatcgtcggcggagatttaactatgggcaattccgatcccggactcgcggagtctttttccggtcgcgttccggcacgttgcgtatttcaattcagtggggcagacggcgtggagagcgcgtttcccgttgaatacgtaatgagaatgatgaacgattgggcggggggtgagtgcgatccctacattaaaatacagaataccggcgtctccgttctaatcgaagggtttttcgctcctccgacaaacgccgctagagcgccgctgtgcgccgacaaagtgaacgtcctgttaaacactaccgattctacgggcgtcgttttatctgatatcaaaaggtttaaaaaatcagtgggtgtggattgcaggcctttccaggcttgcctaaacgttcattgctttgtaaggctaccaaatgttcagctggccttcagattcgtcggcccgaccgatccggccagaacatcaaaactgctcgactcggccgtagcgtcttacaattcgaaagcgaaacagcggttcaaaaacagttcgagggctatcgataacgaatcgagaccctgcgcacttcatgagtgtgttccgatcccggtaagagatgaaacgcagaaactgactagccaatctgatataaggacccctaggcgcgtgctgaccatactcaagaaaatttcgagcggtgagtacgtaacgaccgtacgcgtctcgatccgcaaaattatactgtgcctggtcagtgtattcgtagttataaccgcctggtggtgctacccgctctaaaacctcgcgacgcggcgtcacgtttccagtcggaacaccgcaccacagagtcatcatcggcgccactacatcgcgcgagactgcaatgtctcgcacgccctctccccagctttcgcctgtttcacaagcgttcgatccctccgacttgagcacttacaagttggatgtgctggttaactaccccctctcggatttggtgcatcaccttaatgccataccgcgaaacctgcaagtttccgacaggcattccgacctgaacgcagctaaaatcaacgttttacgggctctttgtgtgggattttctgacgtgcggcgcaaaaatgatactcgcactttacaacgcacgcccatgttcgcaatcggcgacgccgcatcgcgcttgagaccgtccattggattgaaacggacattccccacgggcatattctcaacaactatcataaactctcccgcagacgatgatgcatagcttttgtgagtcgacatgctttaataaaaaattatccaaatcgaacgagtctacttccctatgtcagttatccggtcaggagcattttgattttaaatatctctatcgttaatgtatcgattctggctctcaattgttgtcgtgcgtgtgcgatttgcctggccatcttttcgcatgccctagtgagtgcgtaaagcgcgctgcgtcccacctgcctaaaatcgcgccttgtcaataatctatcggcagagattactcgggacgcgctcgattcgtccgtgctggagcgatcgctatcaggaacactagattgcgactcgccatccgtgttagaatccacggacgatagagactccagcgcaaacagatatcgctctgggtcgatattggagtcctgttgcttattttgccctgcttctgcttccgtgaccacgaaccctctgtacatgttgtgatggtcgtgctttgccgttgtcgccttgcatggcgaacgtcggcacgtattaatgggtttcgactgcgaactagacggctgcgcgggtctcgacagaatgtttcccagaaccgcactactcggcgacgaaggctccgctaatataacgtccgggggcgcaaatgcgaagtggtcgtacagtccgtgctgcgccggactcccgaccgccgcctgctttttgccaccaggtgccgtcgagatatcgacggagcggtcaaccggttccaggttaagatccgcggtaataacggctggcgacgctcgttgtaacaagggagacgagtcgcggcgcacggaagcgagtccccctaaagtatcgcatcttggccttgacgcattgttaggacgaacacgggcggcgcccttgtccgagatccgtccgattgaatcaatcctcgttccggcacgcgacggcttcagcgctcttatccctattcctccgtcttcgtcgtcgggaatcagggattttgtcgaagacgcgacaacaaatggtgttgaggtcgaatcggagtcagatcgatgtggaatgtttggagttccatgctttttcctatcatcgcgtaccgagttatccgaaataactacggcaggggacttttggtcgagagcgcagccgggtgcgttacacgcggctgccgtatcggtaaattttagcctcccacgatagacaggctttggcatatcgtgcgcccgttcgctgacatcgatatgttttacggggcgccccttctgcctctcctcgatcccgactgctgcgtaggtagattgctcgttatgtgtttttttagttacgacgagtttttgagtggctggagataacagggacgggctcaatgtttcattatttgggggggcgagcttatagtgaaaggcgagtttggaagaggcgccatcggaagcatcggtgctaaccgtagaaggacactcgacattctcgggaactacccggtcgctacgatcgttcaactctttatgaaacaaaaaacccgtttcagcattgtcgtagacgtccttctctgcagccatcccatcccacatgctctctctatcccgactaaagtcattccctggtaattcttcatcttccgacgccgttccaatagatagtacatcctcgacatcgccgtctcggctcttgttgtacacggggatcggatattgtctagattcgtcggaaaaaaaattagccgcgtcctgtcggtcgagcacggcgatgtcatcatatgacgcgcccgtttccacgcgaatgcccgcatctatgtatggcagttccgagagaacagcgtcatcgctggaagttagccgtattacggggatagggtcgaataccgtcttaggccatagaactttcacgggaaccattcccgtgtccactatcactaaacacggaggagcggaagaaaggggcttggaggctatgagatgggacaagtgttccagctgttggccgaggcatgcattttcgattggattgctgtcgtctgccaacaatttccccccccaggaagtcgtgtcggatgaaacggcggcaggttcgagaaagcagccctcggagccgcttctcgagtcgaaaagacggacacacagattcagtccagagccggaggaatacgcttctggacattctgcggcgatcacgatccgtgccccgaataatgtagctgcggctgccagatccatagcgtttacttttaagactccgctagggggtgtggacgtgacggtaaatgtcatcgccactcctgtgggttcatataaattgggaccgtctgaacctttcgggatagttttgtcggcgggacgtaacacggacgatgtggtcacgtctaaagtcgaagcagcgtccccgcgggctgtgacgacgtcatcgtagcttctacagctttgctctatctccgcgggtagaagcgaggaccacatcaccgccaatgcggttggcggaatgcacatacgagccagcactgttgtcgttgtcaaaagattcgacggcacgaccgcacgaattttggcaaggcccgtactcgtagccccacctacaccttcccagggtttaagggggtctgtttcggaaaggctgccttgtttccaatcagaataccgcaaagcaaaaagggatccgcctgacgggtcccacgctccgcccgttaaactcatcggtcggcaattcgagtccgacggggcatctttggatagctgcgtagataaacagttgataaacgccgtagtggacagcgactcattgatagcgccatagagcgtcttatccataaaatcgtactggctaataagatcgagctgggaaaaggtcaagacgtgccccggcatgcacgtcataatagcaaccatcacgtcggccaactccagccgaacgggtcgtccatttgcagctatttttttaagcccctttttgtcggcggcaggggcgacttgccccggaagaaaaaaaatatcagacaagctagcacccgttttacgcgtgagcgtaatggccattaatgcgcaataaatggacccgatcgcttttactgtgccatccgccagccaatcgtagttttgcgtacgtacatacttggtgaaggcgcggaaattatccgccgcggcttgaacgaaacccagcctcaaggccatgatgtcgcctagcatgcccgcggcaactaccatatctctagttgacataacttttgaagggatcgcgggcctcaggcttaggccggagggctcgcacaaacacgcggccattttttcaccaacagttcgatagcagacagaatatctcaggggcgcgtcggaggcgtctaaatatgtatggatgcctgggatatctatttcagaaaacgcctcctgcagcgtgacaacaactgatggtctgatccaagcagctactcggtgtttaagatatcgatccacgaaccccgcggccggtctgttgttcgcgtcagcattcaatcctgtatcagaggggaggagcgatggacacccggcaactcccggcaaaatggcggaatatgcagcatacagcgccaatctcagctttacaagccgcgagtatcgagttacgtgccgaacgtaccacttggggagccgtttagagagaatatcgaattgcgaggctattgtactgagatcgtttaagacaaaggttggcgggatctttgcacacagagtgtccatctgtttttgaatcgattccgtttctttgagggccgccagaaaagcatccatgactccggctctgtctctgtatttcgcatcgataagtccgatgattttagccggcagcctagcatactctgcgttatcgcgcaaagcgttgatcgtattggaagagactttagcgcgagcagcactatctcgggcggcggcaaacccctctgagctcttgtccatcctgtccttatcgtgcataaacgtggaccatgtgtcatcccaagcgacttcggcaagcgctagttcggattttaactcgtccaatcggctcgctaagtccgcgagagcatcgatccgctccgcgtatatagtcatcggaccgctttcgtcgatccgggaagttagctcgtgcgaatctatgacagatcgggcgtgttttagccactctaccgtttgggtatccaattctttagtttcttcgactttactcaaaagtattgccgcttgagtgactatgtcgttcgcagtttcagccttttcaatagctttcgctatatgcggaggcatcgcgaccagccgcagcaggttttttaaattggccaattgctccgccgtctctctgtctgcggcataagaaacttcggccaaactcttcagaataacttcagctctcgatttcgcgccctcaatagctgtcgttacccgcagctttattgaggagacggcttctatatcgcgttggagagtatgagcgctatactctgcataggctgtcccgttgaacgccgtaatgtcttccttttccaaatcgttggttattgtcagtatggcgttcgccgaaggaatcacgatagagaccccatattcaagagcgcgacgcgccccctcagggctatacattctagccagattctccaatgcctctctaatttctatatctaccctccccgctgcgtgaagagcctctaccctcatttgttcatgccgagctaaaaagcccgtaaattcctcatgcccgttacgataaaaatccacgtatttggccaacgttgggaccgctcttacgtctggttcaatttcgcccaataacgtgtaatagtccaagttcccgccgcgggcatccgcgtgccttaatatagcgagtactatcttgattaactgtagcaaggcgtcgcagctaactccgaaaagttttgtgtaataaggagccgccgctataaacgcgtctagccaggtcatatttttcaaaaatgctataggaggcagaattccatgaattctattcggggtggaaaacgggttgaacttcaatacagtttctatcgcatcgtgaatcgcacgaccatgcgacataacaattttctcggctctggctctgaaacggatagtgtcgtagccggccaccacggcccttttctccaaatcactcatctccatagcatcaaattcggatttcagctcggcattggatagtagggaatgaatcgaggaaacccaaacgtcttcgctatgcgatctctgggcacttatcagatttctctcgtaggttgtaacggccgcctccaattctacggtccgctgatttacaagccctaccgattttgccaggtcggcaattttacgttggatgtgggggtccgtaacatgcgcgtgactctcgagagctgcgatggctgtattggcgtctctcgcgctctgcagcgcgtgagctatttcagttctggcgctcattataacactggcgtcgctatcagcggctgctgttttgggatctgaagttttgaccttggttattgacgcgatcacgctattgagtgccgcgcgcactgcccgatgtagaccatctaaacggtccccgtgctgcgccacgcccgcggccacctcagcgtcggataacagcaccgttaagaacgaaaacgcgtcatcctggcctgcgggtagatcggccattattcccgtagagggagtgtctgcagtcgccctgtttacatcggatacggcgttctgcagcgccgtaacagccgccgtagttttttcgaccgacatcggttcgaggcgcgcagcggcgactgctgcagaaagcgtatcggcatgtttcccgaaaaaaaccgacgcggccggataacccccaattggacccaatattacgcgtatggccagagagaaaggaatgccgaggccagataactctgcggcagtgctcgtactggggtgtgacaaaattgtcctatactgagagaacaacagccacaaatccgttcgcaaagtcccaataacatcgggtggtgcgagagctagaaaggtctctagcggccccgtatctccagggatggattgcgttatggttttgactgtcgagtccaatgcgcgcaacccagcaaacctttgtagaggacgcagcatcagcttaatcgaagaatataaagttctgatctcctcgtaacgatattgaagtgccgcaattaaggtttcggcatccagccgcctacgggcgatagccgcgcggtcatccgaacttagcaaatttgcaaatttgtcgccccctaaagcatttgacaattttactaactcaaccacatccttcataacttcctccagtttttgaagatcggccgttgtctccaaatcagtgtatgacgcaactctagcttccaactcatgtaagcggtccaaatccgccagggctgtttcacggcgggcggcgttgttgttaacggcatcgacttctttgatcagtgtttcaaactcttgtcgactaatccacccgcccgcttgaacggctgccattgccgttttccataccgccagattttctggattttctaaattagagtcattttccagcagatccccgagcaatttagattccggtgcagttgttacgggcggcggggcctgcgcgccactacgcgccgctactagggcaataacatcatcgagcacagataatgatgcgaacagcctggccattttttcatgttgctcgacaacgaccattttaaatctagatgtgctagccacgttggctcgaagcgcattcgcgctatagagagcccccttcaagtaatattcgtgtagtgcgttgccgactgcatcaacggctgccctctcaatagcagtcaagcgctgtgtaacgacagatggggagactttagctatgctctcgtcgtcgcgcgatccagaagtacccccagatcctcccattataaatgcatcaaatgaggcgtgcatcaatcgaacgccggcgtcgagggcctccaattcagctagtatgagttccgccttcctcctggcaacagtttccctatcacgtatgaacctgcacagcgatgcgactctgtcggtcaagctctgttcggcatgcaaagacgtcttctctgagtatatctttcctggattactattaaacgcgcttactaacgatgtcgccatcctttcgtagattctatctgcatccgcagtgctcgcctctctctctatagagtccaaagttttgtgaagggcatctgtgagctcctccacttccagagccactaataccagcttgcttagggccaatttgcctatcttggaattttcagaaagtacagattctatgaggtctgcagattctccggctcgcgaaaccgccattcccgtagaatcaatgaacgcgctaaagtgggcgggcctcgtaaatgctttaaataatgatgccatctcggcttctacgacagatcctatttccgttgtggttcgagcgccgttttcgataacgtagttgaacaatctggtaaaagtatccagcccacatatatccagaagtccgtcatagtcacccgaccgtgacaagtggatggtcattcccatacttaaagctatagattgctctaaatcatcgatgttagcattgatgtcgctcagaatagagctagggacgtgttcgcttgtccatagcccgtctcgtagcgactcgtccccttcccccgctaccgtgtgaggattaaaaggtggccggtctcgcaacgattggccgtgcacgaagtgctcagcacgcgcctgagaacttataaactcattgaaggagacattgtccggccgggtagcttcttcttgaccaggtatattatgtgtcgtgctcgatccactatctgcttgttcagacaaacttatcgatggagccaccggattgtccgtataggtcaaacatcgtttagttttccgggacggttttctgctcgaagattgaccttggccatcgacggataagttctctgaacttgacggaggagtccatacagggcgcctcctcttatgtctctcaaaagactgtttgggcggggagctagatttcgtgtcagtttcaagccgaactacattttcccgcgttttgggcaaatcaggccttgttagcaccgacagatcatcgccgatgtccgggaatgcagtggtccacgcatttacgatggactcatgattggttatatcacatatggcatcaactggagcctcctcgggaggcaggacgtatgcgtcctcctccgcatagcccatttcccgcctaacatccacatcccctgcagcgacgggagaacgatcacttctggaatcgacagcgactttgatgtcctcgctacgtgacgtggaggttccaatgatgatcctagttgttgtaggctgtggcctgtaagggggatcgagattggccagcactactttaatgttctcttcctcgttaaccctgcctagatccaaaacgatgtccgctgtaccgtacagccgtgatacggctgatattatttcttcctttggcggtgtactggagatcatagatacaaagtaaacaaaggtcgcggaccactctggcgccgtcgagggatccgcataggacgtgagatattgataaaaataaccctcgcttactcgaacgatacacgcttggcctatgtggccatgaccgtgtggatcgaaaatgtagattccgttatcggatctgtacacccctattcctatgacgccgatgacgatcaggcaataaatatcacctcgtttctgcttccatactttttctatgaatgtccgcgcagatatttgggtttctaagatagtggaggtgttttcatctacgtagaagtccaattctccataggagctcgaaaacgcaacacacaagttgccgtcgggctcatttgataagatcctgtttggtaaatcgtgagggacgcaagtcgtataccttccatcgcgagaggtttctattgtccattcctttccctgcaataacagtctatctatggcctcggtcgacaataccgcatccaacccatacgcaaaaactacgcgcagaaacgccaatgacgaccgcaagcatgaaaccgatgaccccggactcaagtccggggcaaattgattcctgttgccaacggcaactagtgtaaagtcggtggcatcaaccaccattcttgcccattcatctaggattacctccgaatccatgtttgttcccgaacgcatggcgcggttttgcatgttcgagacggagctgtccctcgaattatccgatgtttccaagcgccgcgtcgagggactcggttgtaaccgcgtagatttcttggatgggcgtgtagtgctccctctactctcactagcagccatatagacgatggggcggaatggcgcgtcttttcagattgcgctttgtcattgagcgagttagacattaaaagttgattaactccaaaattgtgatcaatcagttgcggccgcgtaagtggcgtggctgcaacatccaagtcggcacgaacgaacgatacgccaggccgtaaaacgatagacgtgtgcgtcacgcattgcgatctctcgcctgcctttcgttattaaacaccgtatcgacaatgtcgaccaaaccgtctacagttactctcggttttatgaggaagtccttcgcaaaattggcaaggtccacatcatcgtgtgccaccgtatccaaatccaatgtatcaaaattgagttcgtcacgatgagttaaattgtgcctcgatgtcagttcgactactagggcggggctatcgtcggttactacgggcagacggcccagcagggtcgctacagctgcgtcgatttcgtcgttcgtgacacggtcttccatatcacgcggaacctcgatccgatcagctattttttgccatactactcccacattctctatagcactggccaagtcctgcgaacttctgtcacgaaacgtagaatttatttccgacaacgtttgccatttgtccagcagccacacgatatcgccggtcccgggcggcgtggaacacgatgtcaaggctctgacgtgcaggtccagcgaattctgcaggcgagccaatctggcatagtcggttccgagggtagaaaaatagcttgctgcctttacgctaaataaaattgcgcgctccattaaattatcgcatgtatgaacttgtttcccagtttcttctattaaagtccgcaacaccattgatttgagtcttacattcgccattacatcacccgaggagtcgtagaattccctgagagccgacagcacatcaacgattttccatgtgccaaaattggcacgcggctcgccacggcggtaaaccgttacagtacctcctgctgtaccagctgcgaatttacacgcaaagaaatgcttaaatatgtacgcaaatttaaccaactgcctggatcgctccgctaaatatgccgcacacttcaacgttctatccgctaagtaattgaattgaagtcctagggccgttccatgcatactaatcaaaagcaaactattcgatatctctggacgggggggcataatcggtctggtctctggcggtaccatctgcacggccgcatagaccacgtcgtacaattcgcccatcagcatttccagattatacgcatcgtccgtggtaggcttggccgtcagatctctagcaaacggagcgagtgaggaaattagagcattgagcttgtttctatgattcacgaaactgccaatgtacggcgcgccgtaatccctggcccaagtcaaaatttcgataacagtgtttatcgggcgttcagaaaagacagatgtcgtgatagccgacaatgcgtccacgcaaacggtagctagaatatatcttagaaaatggggagttgtgctttcaggtgtgatgggcatggattcaggatagcgaattgtcatggccagacgaatcatacggctctccaggtctgggtccactgcatttggtccagagatactctctaaatccgaatggtccacactagctagatgttccgacggttcacctccaattaactcttccggtggcacgattccccatatatgctcggctctggagtcgaaccatagcatgagtgactcctttgcaaattgtattgctcgattggcagtcccggccccgctctggcggattgcgctatccatttccgcggcgaggatcgctcgtgcagactttacatagtcctcgtggggatttggcggtatacatcgccctaatatctgagctatgattgcgctatctaacccaagtacttttatgaaatctgaatcggcgtccggaggaaggccattgtccatataattggttaagtaagtcatgccgggaccataactttccatgagtccgaaaacgatgtttccgatgacagctatgcatccgataacctgttgtacgtcgtcaaatgtgtcgagttcattaacagtaccacgagtttttcccaaatttgcctttagcgccgattcataaacccggcatgcctgtctcacaaaacctctttctataagcgcttccaataactgtctcggcgacgaactgtgttgtacagccccccatgcccgcctagccgattcggagagtttcgctttagcagcatcgagagcgcccccgccgtcatttaagtcgccatcggtaataagccggaccacggcagacatatggatcgctaaggcatcttctgttaatgcgtgatcagctaatataatgtctggtccgttccgcaacttttccgctaccatacccggctgaactgcatatacatacgggtctccgtatgctatggcggcagatgctctaacatcatatgctgttcttttcatattgtttgcctctacggccgagataagttcgcgcgagcccaatgcgctggcatcttctgcgaatagatcctttaactgagaaggatggggcgatcgcggacttttaaaatattgatcgacaagggccagcgtaaatagtattcgagtgagtggcgtaaaggccctatttgttgtacatcgagacataataacaaacggggtgatccacccgacggctatagaaattaatcgaattccttcctgaacaaacgggaaatcgtaaataagtttaaagcgcgtctgcgtcaaggaagctggtagttccaaagcattaggagcaggttgacgtccggataacaacccttcggaagtataatcaaacgcgtccgtggcgatctcttcaaaaattgtcagccactcacttattaggggccacaaaacactcggtccaaaaggacatgatctgcgcagaccgtttcgggtaagccacgcaatggcttcttctcccgtcatttcggccgccaatctacgcaacctacgagaatcgtctttccaggacattttatcccaccttacggaggtacgccacaagatgaatccgacaaaattttgggccagcattgccgcttctgggcttcctgtttgtttgtagacctcgagcacagccgcgaatgcatcgcgccacgtcgattccacttgctgaatactcattgtttctagagcctggaaaaatgatccgatagcagttcttgcttccgcagctgtagcatttccccacggttccagtggcgccgttccagccgataaagaccttagtgtatccagtaaagttttcaacgggaatctcgcttcgccctgggtttcagacatggcgcgccaataggtagggatggatctacgtatgtcaatggaggccgtataaagcttcaataataatacgttccctaaaatgctgtgctccgcaccgcagaaaaatatcgtgtgatccgcagttacaccataccgtactttatcatctccatgacgcatcgagatcccgtataggccggcccacgtaagaggcacacgcgctacataactttgttgcgtttaactacaccgccagtcctgtattgcagtatactaggtgacatacagcgatttttatgtgcagtagtgcacacgcagttgtcgcaaaacgggcttgcaaacgatcatcgccaatacaggatctctttataactggttgttgatagtggacgtcatgaaaaccacttttcgaacaagcgacgtgcaggcatccaacacgcagtcaaatgcctcggacaggctgcatgacatcttacggagcatcaataactcaatgcactccggcattgttcggcgcatcaacataggctatccgcatgcgggcaacaggcgcgggacgttgaccgccggattggaactgttgagcaatacgatcacaacgacccctcccggggcaaacatacaccgctccattgcaaattcggcaggcgaagctacggcaacgatcatacaatctttacgaacatattccggaagtggagatctgaacacgaatggtgataataacgtcctttcccgacagatcagcctgacagatttctgtttccccgatgcggagatgccaggactaattgtcttatctatgcgacatccactggatataaacagcgaagcattatacagcacacctgccggacgggacccacgggcattggagtcagcgtggtatgaattatctgaactggccgcggtatcggtaaacagattagacggaagtggtgtccggccgtccctattatcgctctcatttcttattgcttcccgcgcgggagactatgcggataaatgtggtgctgaggctgtaagagctcacgtgattagcaattacggccgccggcggatagaggacaggctcgacaggttcggaagctgccaagcagcaatgttgagatgtcacgtgttcccacaccgacatatgcaagtattagggggaatggtgtcgtggatcgcacagcgcgaaatcgccagtataaccgccgtggtcaagggctctcaagagagcgccaggacagaacagaccaacaatccaagatcgtcggtatacgttcccgcatgcgcctatctcgatttagataaagagattcacatgctccatgatgacagagcttcttcgctactatacctcgttttcgtttatgcacaacacctcggacgcgagagcatccgtgtatatctcatgcggagtcgtttaggggaatcggtgttcagagaaggcctcggttacctgtactccgggctaagagccggtaacgctattaacggtctggccggtataatagcgccacatggagtagacgcgaatacggaatttccattatcaaaagctttcgaggtacacaaacacgcctgtcgaaacaccggaatcggacctcgagactccgagaaagtggactggcgtttagatctccgaggccgccctacaaagaattcctgcatgtacgcagcatactgtcgcgtagggcacttgaacgagtattcgatgccggcgaagaagtctgaacgttgtggcgggtctgtggaggtccctgttgtatgggtgccgggagtagtgtgggatatcggagaatggaccgagtgttatcagtagagagttggctacaccgagatccggcatcataccttacgtgaactgcttacgtttggggatgtttttgcgtcggtgtttggggaggagtcaatcttataaaaagcctatttgtggtacgcttcggtctcgcgctcactgagcaacccgtattttatccagtctgaaatcagaatctaaaatgcagcgatccgatgaaaacgaatccctcgaagcgaatagaaatttggacaccgcctcgcgtaactgtactgatgtgcaggtagccttgataatggcaacgaaattgcatcgcatccagcagcaacttgcgagcatgggatatttatctggctacgattccgtgcccgatattactacacccgtgaaagttctgcgcgagcgcattacccatctagtaaatacattgaaacccgtttgccgtttcgatgagcgcgtgtactacgcctgcggggagctggtgcatttacggatcaaatcacaggaagctacttttgatgcgtggttgatgtcgaaaaaattaagcctgaaaggcgagatcgtagataacatacagcgccacagaggtcacgtagagacggatatgctgcgcttttacggagtaacctatccctggctgaaacgactgggtttacagtcggcgttgaaatacgaagaatatctgactgagttggaagacggcaaaaaagaatctctttgccagttttttgttcggctggccgcggcggcagcaaccgaagcgtcaaacaaaaaagctttcatgtcggctttgggtaccgaagtgtcgacctgggaaacggctttcacggctttttttttcgctctcgctcgtcagatatttgtcccatcgactccctgtatgctttttttggggcgcgaaggaacctcaaccgcgagctgttatctcatggaccccagaactataaatacacacgatacccttaaagcgatcgccgacgatatagttccccatctcctagcgagaggagggatagggatatcgttgcagcatttaaaccaaaaaacaggccttatgcctgtgatgaaagtattggattccttagtgatggccgcgaatgcgggggagcgtcgacccacgggggtatgcgtttatctcgaaccgtggcacgcggacatcatgtctgcattaaatatgcgcggcatgatggcgacggaagagtcccgtaggtgcgataacgtatttatcgccctttggacttgcgatttactgtttaagcgctacgagagacacgcaaacggggagaaaaatgtgacgtggaccttattcgattcccgcgcgtcgatattggccacgcttcacggatcggaattcgaaaaggagtataaccgtttagaagcggaaggtttaggcgtagctagcctccctgtaagggatttgatgttcgcaataatcaaaagtgcggcgtccaccggtagcccctttattctctttaaagacgcgtgcaacaagcactacattacagatactcaaggagacgccattgcaggctctaatctgtgtaccgaaatcattcaaaaaaccgacggaaatacaaacggggtgtgcagcttagtaagcgtcaacctcgcccgatgtgttttcgacgagaacggagagaaaaaatttgatttttccgcccttagacgcgccgtgcggctggctacggtgttcgttaactcgataatgtctagcagcgatgttccgactgcgaaatctcgttccggtaaagatcgacacagatccatgggcataggcgttcaggggcttcatacagctctgttgtcaatgggtctcgatttgagcgatgaacgcgtcaagcccctcaacaagcagatttttgaattgatgttgttagaggccatgacggtcagttgtgaattttgcgaaggcgggttgcccgccttcgccgacttctccaacagctattactcacgggggcgcctgcattttgatggctgggcaaacgtaggcttaagtatgcccgaagagtggaatgcgctgcgggagagaatacaggcgtccgggttatacaatgcccagttcgtagcgttgatgccgacagccgcatccgcacaagtaaccgaagtgagtgagagttttttgcccgtgttcagcaacatgtttaacaaagtgacgacggcgggggaactactgcggcccaataatcaattaatgggagagttgagggagatctatgcggataatgaggatcggcgattgaaagccatagcagcgttggagtgcgcgaactggtgcgtggagaccgctctgggaaataagcccgaatgctctcaattacttaaatacaaaacggcgttcgagtacgaccaatccctcctaatagatttgtgtgccgatagggcgccttttgtggatcaaagccagtcgatgactctgtttgtgacggaagcggctgacggaacgctgctggcgtctcacgtcatgaacctactcttacgcgcctataaagccggcctgaaaacaggaatgtattactgcaagatacgcaaggcgactaatgccggagtattcagcggtaacggcgaattgacctgctcgtcctgcatactataatctccaagcatcccggcattttgaccatggccacgcaagcacgcgggaacgaatttgtcagcggccaaaccgcacctctgcacaaaaacccgtgtcccgaaaacgcggcggccgtcctaaagatggaaggtatcgagatcgaaccttcgactagttccgctagagataattacaaagtgtcacggtacttctacgtccccgaatgcccagatatagggcacctccgagctttgagtattatgaaccgatggacggagaccgaatttgtcgtcgccgaggatctcggggacgtcgccaagcttagcgaagaagaaaaaaatttctaccgattcctctttacgtttctctctgctgcagacgatttggttaaccttaatatagacaatctgttaggtttattcgaacaaaaggatattcaccactattacttcgagcaggaatgtatagaagctgtccactctcgggcctatagcattattcagctgatgttattcgacaacgactcctcggcgcgcgcaaaatatgttcagtctgcgttagagtcccccgtcatccaatctaaattggaatggttagaccgacgtatactagagtgcacgtctataccagaaaaatatatccttatgattttaacagaaggcattttcttttcagcatccttcgcggctatcgcttatttgcgcacgaataacctctttgtcgttacatgccagattaacaacctgatcagcagagacgaagcgatacacgtagaggcgtcgtgctgcattttcaagaattatatcgctggcaacaagccatccaccgctcgcatccaagccttatttagcgaagccgtcgacttggaatgtgcatttctccgcgcagccgcaccacgcgactctcgcttattggatattggctcaatctgtagctatgttcgttacagcgccgacagattattgagaatgttggacgtgccaccgatttacggcgaacccagccccgctgccgactttccgctatctctaatgtccgcttcaaataatacaaatttcttcgaaagaagaagcaccgcgtactccgggagtgtatcgaacgatctttaattagcctgtgtgcaactgtactttctacccctacccacaagaattaataaatgaattcaaattatcgcttttcgcaccgtgtagtttgtgatgcatcccttccccagtaccttatcagcacggagtcgaaaggccgtacctccgggatacaccttagaaatgcggttgaaataactgaagcttcggcctcattgggtatactgcgaaacaccaattcttcaaccgctacatcgtcacgtatatcctgcattatggggaatcgttttaaaatactaattctgggcgttctgcgctcgggcattatagtcgcaatgacgtgctttatgaacttgtattcgagaacttcgcatctcgtttttggggggtgcaaagatcttaacaagctgtaattggacgcgagatccctgttcgcatcgggcatatcagccggtctctcgtaatgatggccgcccgtgatctcaggattgcaacaattcatcaacgacgaccggccacgctcgttatcgctcgctttaccgcagatagtgcccgaaccctgcttcaatgtccctagatctattatctcttgcatggatttcagtgtgtgttcgcaatggaggtctgtttgacaccgaacgaagttagacaaaaacgtgaaatagtccatttttaacgccgccaaaacatctctgcagtagatagtcggcggaaatattctagtaaggtcgatgattatatcacatcccatcaatagcatgtctgtatctgaagataacacatacgcaaccgttttggtgtgaaagaggttagcacagatatcgtccgcttccatcatggccacatcgacataagggtatcccatatagcgaatggtatccatgcagagcctatgtagaattttgggcgtatcagacttatcgctccatctgcgtggtcttttccgcttccgcgttcttttgttccgcgcttctccggtatccgcattctcgcattcgtcgcgcgaacgtacttgcagcctcccagaacctcctcccctcgcgatgcgagtagctgctagcgcctttgctccataaagcgttttcccatacttcgaaaacccccggtccgatacaaacaccggataatacgaccgttggtgtaacaaacgcagcagacagtataagcaccgcagcgtggcgaccgagttgtcgactccgtcgaccttaccagggtaaattttttccagcagtccatacataacattccataaatccacggcaatgggcgtcatagccccgccggatatcgaacccgaaatgtgacttctcactaatccgttcgcataggcgaagtgcatgcaaccgtacacgcccatggcaactttcggagtcgcagtgtaagagacacggggtaatacgaattttgaattttgggagtatctgtcaagtatattcaactcttgaataaccacgaccaggcgtagctatccaaatgccgaaacgttaagccgctccataaaaccttgattccactattcaattgtgcaatagttggattagggcaggtattcggctctatctgttcaccgtatacacgctataccgtcctttaaattagacaaggtgcgcgtctctaaacctataattcccggtagcggtataagcgacacttattacatgcctatccaccacgtgatgcaacccacacgattcacgttgaagacatgtgacatttgctgtaaatatacgcaggtaacaatgtgtgcggcgaattagacttacagccaatagtaagcgcgacataacactaaatgggcggcgcgacattcgagtgcctataggagaccgatatacgtaaccacgcgtggtgcgattgcgacccaggctccttcgatataagctttccccctcacatccggagccatccgttagattgactctgcctcagcctatacaacgcgccaaagaacagtgtgctacggacagaagtgacgccgacttgagttcacggcatcgagaccccagaaccggtctcggcgatggcgcgaataactatgagcgatgaacacatcatagacgatgcaggggccacttctaacgattcgcccaattcctggaaagtcgtcttggccggagagaaatttagaacggtatcggctgcagtacgcgcaatagtagattctgtgaagaatcccctaatcatattcagcgacgacggattaatgatacagggcacgatttgcggtcagcaaacattcgttcctatcgagtgcgccgcctttagtgaatttgaatggcgcgggtccgcggccatattcctggcgctaacagattcgaggcgtactttattagacgcgtttaaatgcgacaagaaaaaagcaatcgaggtctcctttacgttccgaggggaaccgccgtcgcgacatctaacccagacagtcacgtatgtaactgataacggatcgttctcgagtgctatcatcaagtatgaactgtggtgcgcctcagttttattcccgcaaaaaattcccgatgttacgttctcagtaaacaaacagcaattaaacaagattttggctatagccgccaagagacggcacgagcaactaacatttgcgttgaaagcagaaggggggttttatgccggaactgtgtgcgatgttataagtttcgatgtagacgggagcgcaatgactcagtatccgtataatgccacgactgcggtctcgtctgccctcgtcttagcatgcgggaagaaaagagccgcccgtaatgcacccgtgactgcatatgggagcggaaaacctttctgcctcgcactggaagacacgaccgcgttccgaaacgtcgtacagaaaattaaaaccggctcggcaggggcagatttgggattttatacggcgtgcaatccaccgatgctatgcgtgcgtccgcacgcgttcggcagcctgaccgcttttctattttgcaactcggattgcatgtctatatacgaattggaggaagcgagtgtagcggtcggcgcagtaacatcgaaacgcataaacgaatattttcccagagtatcgaccatcgattcccggaaaaggcgcccgtcttcggtcctctcggagggggatgggaaactccttaaacccgacggccaataggtctcgtgtccgcgcgcggaccacagtcatgacgcggggaggtcaaactgatataagatgtgataagactgcttagatttcattcgacctggttattcggacatacatggagcccgtcgacaacgcgtctccgttacctccgactggcgcgggacactgtcttcataggattgtttgcatcgaccctccatgtacagcaaccattggcagcgggaggagcggcaataggtgcataaaatgtattatggttacgacgggctccctgttatcgatggccgcacacttgaccgtcaccgtattttgcgtttccgtgattccgtgtatagatcgaaccgcagcctatccacgctgcactatgggcgccatcttcgcattcctattcttttttaacatgcggcttactgcacgatcatcggaaatagtgctgctcattggcagaccgacacaatttttatgcgctctgacagcatcaatcgccgacacggtcgccaaacatctagcggctacccataaggattacctgacgacattgcgagcaatagaagtaatgtctctgttgacttttgtcatgctcggagctctgatcgcatcttatcattacgtctgcatagcaacgtctggagacgtgacgtggaagaccgggtttttagttgtggcggcagggacgattgccggcatcacggctccgtatggagacatttctcctctagccggctttctttcggcgtatacggcgttagctattcacgtggtcagagacgccagtcggtctctaatgaacacgtgctactaccgtgcacgtcgggaaattactgtgaacggtgcatatcgcctcggtcgcgcgcgtctcccgcccagcacggacgccgaggcgacgcgcgaagaagacgtatccagttacgatacgctgggggggaatattcctacgataattctgagcctcatagcggtcatctcgattccagccatagccagctttcaaaagtacatgtcgaacgcaactaagcaccagtcaacattgactgacacgttacgcagtatatgcggtttcttggtgggtacaagtgtcgcgatattccttccgtcgcgctaccacgaggttctgttccgtccaattcttgtattactgttaatattcggggcaatggctactaccttagccggcttcggtttacttctcgggccgacattgttttccgcgacagccgcggttctgtgctgctacacttgtataaatgtacgcaacgcgaatagcggaataaagcaattggcggccgccgcagctggtaaatgcatattaggaactgccatctcgagcatgttggtttgcgtgttaatacaatattcctgatcgcggagcgattaatttttatatcatgtgctcatagcgttctttcgaactgcgaataaaactttcgtggctactaaaggggcctatcgtgggtttatgcgctgtcgaaaacatgaaagggccgatttaaagctaagttgcgcaggcagaggccactccatatacgctctcggagacgcggctcgcacgccagctgaaatattttccccatgcacgcgtcacgcgcgttgcgagctttggggtggacgagactcttatttgtcgttttattttcgggccgcgtcctaagcgctagcattaaccccgatctagctacacccccggtcattgctttcaacccgtcaagtattccggccgatgatgggcctttggccaaagttcctgcatccccgccggcaggggagaaagaggagagccacaagaatgcaagcgacgcgcgtaggatgcctagtatagtttgcgataaagaagaagttttcgttttcctgaacaagaccgggcgtttcgtgtgcactcttaagatcgcccctccctccgacaacgaatggtcgaactttgctctggaccttattttcaatccgatcgaataccatgctaatgagaagaacgtggaagcagcgcgtattgctggcctctatggggtgcccggatcagattacgcctacccgcgtccttctgaattaatctcttctattcggcgagacccccaagggaccttttggacaagcccatcggcacatggagacaagtacttcatatggctaaacaaaacgacgaatacgatgggcgtggaaattaggaacgtcgactacgcagacaacggttacatccaagttgccatgcgggatcctttcaatcggcctttactagataagcacgtgtacatccgcgtgtgtcaacgacccgcctcggtcgacgttctagccccccccgtcctcagtggcgataagtacaaggcttcatgcatcgttaggcatttttatccaccgggctccgtctatgtgttctggaggcaagatgggaatatcgttacaccacgtaaggacacggacggaagtttttggtggtttgaatcagcccggggagccaccctggtatctacgataacgctgggcaactcggccatcgaccctcctcccaagatttcatgtctggtagcctggaagcagggaaatatgatgagtactacgaacgccactgcaatcccgaccgtatatcatcatccccggatatccctggctttcaaagatgggtatgcaatatgtactacgcaatgtgtgccgttcggaattaccatacgatggttagtacacgatgaacccaaacctaatacaacttatgatactgtggttacaggtctttgcaggaccctcaagcggcatagaaatatcatcagccgaatattactccaagatgactggcagaaaacaaagtatacatgtcgtctcatcggctatcctttcgacgaagacaaatttcaagctttcgattacttcgacgcgacgccatcgacgagggggtcccccatggttctcgcgatagcggctgttgtgggactagctttgattttgggaatgggtacactcctgacggctctgtgtttctacgcctccgggaaaaaatacatattactttcgtccgtctagtttgcggtgacattgatctggctcattatatgccccgagctcttgtaacatcgcggacgcgatttccgtagtaggcacatctcaaatgcaaaagcggcatgtcaaccgtataggtacatccggccctgcttacagtcggtagggcatatatccaccggaaaacttcagctttagactcctcaggtgatgaggaatagtatgtaaccctctagcagtacggtatttctaaaaaaaggtagatccttttccacacggcacagactaaataacgtacactacacaggttctctcgaacttcgtttggaccggaattattccctcggcagcgcctaaaaagcaaacctctagagtagataagtgtcagtgaacctaggccttctttgttccacggctggaaagctaagggacgaggtacacgcgaccccagccacgcacgaacagagtttaacggaagcgtcgtttgcgggataaggttgtcggaccccgcgggtccgttgaaaagtggctgcgcgcctaccgacgaatacgtcggtaacaattttagaaatcgaatatgactgcgagtaccgtacaatcgcgaaatacggtctctatatagctactcggtccttaaatatgtaagtatgatgtcccctactcccgaagacgaccgcgacttggtcgcagtacgtgggctgctccggatgatggacgagaccacatctgagcgacacaaacgttcgcgttcaggatgcccccggttgttatgcggttgtacgatcgggatcgctcttactgtgttcgtcatcacagctacggtcgtgctagcttcgctgtttgcattctcttacatgtccctggagtccggtacatgtcctcacgaatggatcggtttaggctatagttgtatgcgcgcgatggggagcaacgctaccgagctagaagccctagatacgtgctcccgacataacagcaagcttgtcgactttactcatgcgaaaattctaatcgaagctatcgcgccgttcgcctccacggacgccaatagcagcaacgtcttccgactacgcgatagtagaacaacgtgcgtacgccccactgccgcaggaccggtggccgtcgactgcccgaggacctgtaccgccatatgccagcggccgcgcccattgagtatcgtcgcttcgataatcagggacgcccgtacttctcttcgtctagaacgtcgcgaatattacgaagtttatacggccattctctcaaatggcagcgtgaaataaacgcgagagaccgagcattagagtagcacttatttattctatcgcagagaaacaccgcgcgcgttcaaaaaaaacacaggctcgagtgccgcatcaccggggccgcctaggccggatcccccaactccgcccgttttatgactagaaccaatagtttttaatgccaaatgcactgaaatcccctaatttgcaaagccaaacgccccctatgtgagtaatacggggactttttacccaatttcccaagcggaaagccccctaatacactcatatggcatatgaatcaacacggtcatgcactctaatggcggcccatagggactttccacatagggggcgttcaccatttcccagcataggggtggtgactcaatggcctttacccaagtacattgggtcaatgggaggtaagccaatgggtttttcccattactggcaagcacactgagtcaaatgggactttccactgggttttgcccaagtacattgggtcaatgggaggtgagccaatgggaaaaacccattgctgccaagtacactgactcaatagggactttccaatgggtttttccattgttggcaagcatataaggtcaatgtgggtgagtcaatagggactttccattgtattctgcccagtacataaggtcaatagggggtgaatcaacaggaaagtcccattggagccaagtacactgcgtcaatagggactttccattgggttttgcccagtacataaggtcaataggggatgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactggcacgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttcggtctgaccaccgtagaacgcagagctcctcgctgcaggcggccgctctagaactcgtcgatagcagcgatgggctccaaaccttctaccaggatcttagtacccttgatactgatcactcggattgcattgatactaagctgtatttgcctgacaagctctcttgacggcagatcacttgcagccgcagggattatagtaacaggggataaggcaatcaatatatacacctcatctcagacagggtcaatcatagtcaagttgctcccgaatatgcccaaggataaagaggcatgtgcaagagccccattagaggcatacaacagaacactgacctccttactcaacccccttggcgattctatccgcaggatacaagggtccgcgtccacttctggaggaaggaggcaaaaacgctttataggtgctgttatcggcagtgtagctcttggggttgcaacagcagcgcagataacagcagctgcggccctaatacaagccaaccagaatgccgccaacatcctccggcttaaggagagcattgccgcaaccaatgaagctgtgcatgaggtcaccgacggattgtcacagctagcggtggcagttgggaagatgcagcagttcgtcaatgaccagtttaataatacggcacgagaattggactgtataaaaattacacagcaggtcggtgtagaacttaacctatatctaactgaattgaccacagtattcgggccacaaatcacttcccctgccttaactcaactgaccatccaagcactttataatttagccggtggcaatatggactacttattaactaagttaggtgtaggaaacaatcaactcagctcattaattagtagcggcctgattgttggctaccctatattgtatgactcacagactcaactcctgggcatccaagtgaatttaccctcagtcgggaacctcaacaatatgcgtgccacctacttggagaccctatcagtaagcacaaccaaagggtttgcctcagcacttgtcccgaaggtagtgacacaagtcggttccgtgatagaagaactcgacacctcatattgtatagagtccgatctggatttatattgtacaagaatagtgacattccccatgtctccgggtatctattcttgtttaagtggcaatacgtcagcttgcatgtattcaaagactgagggtgcactcactacaccatatatggccctcaaaggctcagttattgccaattgtaagataaccacatgtagatgcgcagaccctccaggtatcatatcgcaaaattacggagaagctgtatctctgatagacagacattcatgtaacgtcttatcattagacgggataactctgaggctcagtggagagtttgatacaacttatcaaaagaatatctcaatactagattctcaagtcatcgtgacaggcaaccttgacatatcgaccgagcttgggaatgttaataactctatcagcaatgccttggacaagttggcagaaagcaacagcaagctagataaaatcaatgtcagactaaccagcacatctgctctcattacttacatcgttctaactgccatatctcttgtcttcggcacacttagcctggttttagcatgttacttgatgtataaacaaaaagcacagcaaaagactttactgtggcttgggaacaataccctcgatcaaatgagaaccactataagggcatgagcttgatctagagcggccgcggggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttcggatcctctagagtcgacggccattatggccgagatcgagtgccgcatcacggggtacgataaatttacgcggccgcgctatgtttactttatacatcagaggtcatcgtcaacctgcgcaaaatttccgttaccgtaaccgtgccgccacgatgcttgcgcacggcttttgggcgtggaccggtcggtgcctccaaaaggcgttcggggggcgtttcggggaccgtactgggagatccgacagccacggcgttgcacatatctgccggaatcgccaatcccgtcgtagaagcacaaccattcctttcaatcgaaaaagtggcagggagggttgcggctcggtccgatgcgggcgaaggctccgcatctgtgcgggtcccatttgacgtagatgccgtagtcggtgtcggggagcggagataagttagcgagcactgagcgggaggcggggagtcttgagtgaagtgcatagtgaagatggactgtccattagaggcaggcgcttcactggtctcgcccccgtcctctacccacgcacgcttcgattgctggggcgagtcttgcaagcatctaacgactgagtcacctcccttagccgcgggttggtaggtgaccgtcgacttaactcgtgcgtgtttgaaccagagcgccaccgtggattccgtgtcagcccacgtgcacgagttcatggtcggaaatagctcccccaggaagcactggaaccgtttctgttgccggagagcacgtctcaatgttgagttagccatgccgccctgcagccataccgcatacccgttaaagaccatgttgaggatatattgacagcggtaattcaaaagaccaaccaacgccacaatagcgactacaggccgcgatacttcactttctgggctgcttcgccacgcgcagcacgtccacaaagcgcccatgtgaacaagaggggctaaaacggttccgataaaatggcataacatcgtagtgtcggcccagctttccgatggtagggaactcacggcttcggcaagggccaaaaatacggtatcaaagtcgctcggggcccgagggccgaagacgttagggcacgcgcgcagatctaacacgtccattagccacaccgcccacgtatacaacgtccttacataactcagcaatagttgcaagcgtatcgacgtatcggcactaggcgccgttacatcatcgggtctcatgtagtaggcgtatttttgaataagctctgtcccgtcccgaatctctcgccaacatctgagatacagtgcattatctttcgcgagttggaacggtttcttgaccaaggcgttacgattaatgatagggtaaaagagcaatgctgcttcacgtctagtcggatcgcaggtctcgggcgaaccggcacggcatccatcgcgtctcatctctaaataattcatgtaagaggcctgataacacctcttgaccgacgcacgagtcagcttcttttttttcatacggcgcgcaatgcgcgcgcggtagggcctcgtatactcttccgaggcatcccctaacgcgaggtagacgacgatacattccggaactttgttagaaggagcgtcgcgcaacagcgtttgtcgcaaagcagagagaaatcctgaggggagcacttctacgagcgcgtcttcttgagctcggatacccgaaagagatgtacccgttgtttccgatagctgacacgggtactcctggacgcgcgtcggcgaacctcgtgaccgggaatttaacgccaacgaatccgtctccggctcgggagaagttggcgtaaacaactccggcgacatgctagcgcaagcatatcggtccatcggaatctatacagattaggcgcagtacggaaaggccgacttttgggacgcgaagtggccagaagcatcgctttccttagcacaactattcttaaatgcgatgcttactcagggcggattgatagtcccgcccatacggcgcgtcaccacgatctgcacgccgctccgtgcgctttttttttaccggtccgtttttttgaagatcgcctccttcgcatcttctaacacatcctgcagcgaggctagcgtgccgagaaggttatacccgctcggaggcggtactagctttagagcttccaactctccattcttctcctctccacgaatcgctgtcgcaatgccgtcgggcgggtctcctcgctcaaattccaattctaaatactccatagcgtcgtcgcggtcggctatatattcatctacgctaacaggtcgatacaagcctttacatacgtagcacaggtggcggtatagcttaaacgtttccgaccaaacgtctacagcgaggtcgtggtacatggcggcgatcgtgaggtgcgcgacgccgatattcaaatgccctagcagacgttgcagaacaatggtagtggctaccacggttgcggttaaggtgtctcccgactcgatatctctctcattcgccgaggtgctgcgcgatacgaactcgttcataagctccgtaagcgcagatctagtagcgacataagccccgacgaaagtctcccctagcggcgcgcccccggtaccataagaagctgattccaatctccccaggcacattccttccgcataaagaacatcgaggctctccattgggagctttttatgaccacggcctagcagtcgcgcccacgcgcgaacacgattagctttgaaacggtgaagcattcgacccgacgaaacatacaggaactgcgcggcgatactagcagccacacatcccacagtaacgcacgacgatagcatttcaagttcttctttcgtcacagacaccgtgtcagacgacactctcgacaataaaaacacttctgcccgtagcatagcggcagcggcatagcgcactgcacttttacacttcgatcccaaaatgcaacggagttctggccagtacgccagagagccgtaggaagcacgtaaaattgcagcagcggggcccttcgccttacggatagcgccgccttcaaacattttagcgtcacccgtaggaacgcgtggcaaagacgacaataatttggcgcgaccgaatttggaaaagccccctttatgtatcctcaccgctagctccaaagccgaggtaattaagaaaataatagcgtctttctgattcagctcgccagacactacggcactcctcagggcatctatcccgaggcagagaataagcgcgtgtgcttgcttcgccgtccgtttccaggcgagagcgccttttggtggcgcggacgtatacatatcccccttggcatagtctgatctgctgtcagaatgccaaagtggaccgtccccgaaagtattgccccgggtatgtagtaatttgtcttctcgtatagcctcgactcgaggcacgggttccaacagccgccgcaacggaatgaacgtgccaaggctctcgataaacgtcggactcgtgccttcgaccttgatgctattgagatcgggttcggccgataaaggggaagggaccgtgtaagcagatacgacccgctcgtaaggccgtaaatcgtcatcatctcccgaaaagctgtcgcttcccagagattgactcttttctctagacgatgcacccgagcctttacttatccagttctgttttaagtcagacggcgcacgctccaagctgctgtcgcgattaaatgaggttcgatcctcatgaccgccggctctcggtcctcgcctgcgtgacgatccgcggcgtcgtccgcgcacgcgcccagaccgagccgcatgtgtgtattccccccctctagatgatcttcctctaaactggacccatcttctggatcgatggcgaccttcagagccattcgagcctatcgaagaccggccagaacccctagaataatgcgtgcgcacgctagcgtttcgatgtcgccgtctagatgacgacctccgacgtctagacctaggtctcgacctcgatgaggcgtctgtcatgtcgcgcgacgcatcccggcctgaacgatccgaagagcgtccctcccgatctctgcgatagtgcgtatgagcactagcgttgcgatgacgacgcctagacgaagaccttcgccgtttagaccgaggtttagatctcgacgatgcgtctatcgcatcacgcggtacatcccgtcccgtatgctccaaagggcgtctatcccgaaaagtatctcgaatgtagccaataaacccttgtccgttgcgacgactcgtagatccggcagagctcctatatccatcagtctctaggcgatcgtacgtatcgtcgtagttcgtctctgatggtcccacgtgtatgcttgccatgttatagggacttcgcgataatcggacacgcgttttagttccgcgcgttacataatctcggaccgaaccggttctctgtcgctgctcttgaccgacatccccatgacggtgtagagccagcattcgccttcccgtcacaactcaccggcaaagtacggcggccgtccatcgccgtctcattttatacggtgcctaatcgaacggcggaaccgtagctatatcgaccgcgttccattgagaagggggcgcgaggaacggtaacgaagtaaatataataaaatcatttattagctgtcgcttttacgtacaacattgttttaactacaaaatcgtaccgtcgcatcaagtattacatcaccgtttaccgttcgcggcttacattgtgcgagcagcagcgatatcctcggcaatcgcgggcccgggatgtgtagaatcccgcaacatcgctttcacgatagtcccatggccacacgacgggccggccttcccagcgcggccgctctctccccgcgctgatgatcgcggtcttggagggtgcatgagagagtacacttccagctttgatttgatgcactggaatagatacgcggatgccctaggcgcgtttgctaaaaatgcaggcggggctgtcaaaggcataccccgctcttccactaactcgcatcgcatcaccggcagtccgagttcggaccgtacgtaattttgtgttcttaattcggcggcggttaacgcacgcccttcaactatcacaacgccgtggttaaaaataaccggttgaaataaacactgaaagtgtcgtaattggtgccaatcgcaccgcaggtgtgcaaataagttttgccttttcctctgactggcttcgagtcgccgcgatacatctcttgtaaccgaaaggtataaatgcatatacagaagtcttgcgaaccttgccgcttcccggtaatacgccccggcgatagatcgccggggcgtctctgacctgccgacgcacatatcgcatcgcgagggttcgttcgctccctgcctaagataacatgccaaagcacgacaataaccgcaaagtagagtgacataggatttttctctagcttccaattccatcgaaaagaatttttgaatctccgtaacataaacaggcaagccgtcctttgttaatgggggccgcgggacttccatcccgcaatgttcgtttagatttatcgccgtatatgcccatttctcttcggacgccgcatctaggacttcgctaggagagacggacagtagggttgcatgttcgtataagtgcccattaatcggaaagcacgagaacaagtctacgtttagtttttccagccgagataacagggacgggccctctgtaaaatccagttcgtgcaagagcctgttgtacaagcggttcggaggattcggatttggggacggaagcgaaattttgatcgaaaatggagcactcaaagagaacgaggcagattgctccgcgcatctcgtttgagagcaaagagtttcgctaaagctttcaatgccgcggaggatgtccgaatccaaacagtccgtcattccgtttacgggcgcttcgatctcggcggataagtccgtactgtcgcggcgagcatctcgactccccggtcccattctccgcgtcgccatccatctgcttagtagcgcccgccccactaccgatactttatgtgacgctattcactctcgctactatagttaccacgggaacttgagtagtggcgacgtgaagtcgtcggagcgcgaccgggggtttttgagcgacgatctctcttatctaccggagtgctctcgtcaccgtcgcgttttccatattgggatctggacttagggtttcccatatccggcgacagtccggactcctccgataattttcgcgtacatgcctcagcttcatccaataggtttgccccttcttgaatcgtgatcttgattatagccctggcgaggaattcctcgagctccgcattggtcctcggggcgttccgacgccaaagggaaagcgctcccctatatgcatggtactgggccacagcagctacggctccgcagaatatacgctcgttatagacgagcgtgtttgatcgccaggtactagttgctgacgccggagtcgtactaaaggcaaatttccctttttctattgccctggctccgggtttggcacgaactttggaggacagcgactcccctctttgggtttccgatgaggaatcttttctttcgatctttacagatctgcgtctttgtaatgaatgagacgggggggagatccggtccggcgactcgttcttggacgaatctcgtcgagcgcgggtcgacgatatatgggcactattatccggtgacgtgcgcatagttgagcgacgtcgactcgacttacgtctatccgaatctcccattgtatctcgtattaggcagccgattacagacgcgacgggccgttacgtttcaccgtgttgcgtctccgacactgatcaagctgttcacggcaatgacattcttatacgggaacagtagcgcccacgcccacacgatcttaccagccgtcatcgaacatacttgccgtgaatagtcggaagcatgcatggtacgacccggccaagagggcggagattaccgccaccagacctagataaaaaaggaccgagaagccagaagaaaaggctatagacacgcctacggcggaacacgtagattcccagaaatttcctgccacggcgatcggccttcccgaatcgatcgaagtagctcgcgactccacgagggacgcaattacgcaaattaacactttacagaccacatgatggatgtcggacaaacccatccctgcggtaacgctttggaaaagatgtcctcgcacgcgtcgggggctccgtggcgcatgcagttctccgtcgatgaagcgatatatgcgaggaacccagaaggttggacctgttatatagaagaacgcgacccgcgctgtcttcgcgttatcaacgactgtgcgatctcgttgcccaaacgcgatgttaagcggaagtatgaaatatgtgcgttagatctaggtgtacgagtggcagttcctcggaattatgtcgttgtgctggcgaaattgacggacccggatccaacgtctcggggcgtacccgtaatccgcgttgccaatggactaatagattctggatacagggggaacgttcgagtggtacttttgtacgaagcagcttgcaccattcctaaaaacgggctggttatacgtctggcgctcgtgcagttggcctatccggatttcaacagtcgcgtgctttttgacctcgctgatatcacgccccacttggattgcgggcctaacttttcgatgtcgattgcaaccgctgctaaatcgcacagcgctcaggctcgaccgctattgccccctggcggcgagaaactatggccgggaaccgggtgtcgggcactcgtctgtttgtacagcgatcgcgtgtctcgggcaactcattataacactttagacagcaatgtcatatttgccgtaaggtacaatgattctacgaccgttatcggcttaaaagatgtcccgaagtatgtgcataaaacatttgtacggttttatacatccggtcaatttgcaacgttcgttcctttttacgagacatttaatacaaagcggcacgaagatgcggcttacgatatattcgctccgagcgacattgtattggaatcaatgtcttctgtaactatcgcgatacagcagcgatatgcatgtgcggataagtcaatggttccttggatcttcggacggtcgtccatgaatttgcgcgggttgattatttccccatctaggtggatgcccgattcgtggttaacgctgactttatgcaacttaacggaagcaaaagcgaccattaaacgcggagataggatcgcccagctgttgttagtcaatcaggaagccgctgcgttgcttccaacggaaggcggcacggctgcgctgttccctacagtaggtaaatgccgtcgtcccgcagcgtccgcggaagctaagtggagggaaacggcagcattcgatacggaatcgggcaggagcgagagagagtgtgccggcttcgggtcgagcgggcaataatgtatagttgcgcacgattacatacaaaacaataaacacgaacaccacgctgcgttctggacaatcagtttattcagttacacagtccggtaacatgccctcgttgactccacatgtcttagcccttctaccgcttcccttacttacatcacatgacgttgcacatgccgcttgctcggcttcagagtgcggcggcgaaggtagccctcccacccgaccgtaaatatctgctccactttcgtccccgcagttacgggggtcagtagcttccgatagctctaagttttccgtttcgggacacgcggccaacgcttcgagcgagcaatcatttggggaagattttaagcctaacgctctttccactagagcgatatcattcatagcagtctctgtagcagcagttatttgtatcgcgtgttctacgaaggcatccgttcgtcccgtgccgacagacatgtagatctgcaagagggcggcggcacacgtgtccaccattcgctgcgcatttttgcgatgggtctcgacgaccgcgtcgagcccaggggttccttgtcccgaaacatgacgagataggcaatcgagattacggagacacgcactgtacattctagccaacgactggccacgaaccagttttcgcactccgtcggcagacaatatcgccatttctaatgtgatgggcgtggggagcataagattgacggcttgtaccgcctccctgaaacgatgcataactctgtcggaggaagacgaggtagacagtgctgtgtattccggctgaatttttctagagcgccttcttaacccggcgtgcattgtggccaaatcttctattatgtccgatataccggaggatgccgaccctgggatcaaagttttgtttgccgttgatggttgcgccgtctcgttctcccttgcacttcttacgggtcaggtcccatctatcaatcccgtctacgttatcagccactgggatccgggcaatcgtttgttagatgtcctttgccaccgcgcagacgatcgcgactgcggaagaataccgaatgaacgaggagatttaaacgcggtctccgaccctctaaaagtagagttttgccttctcagtcaaatgacacgcggtttgggcggcgccgatttaaaattgcggacgcgagcgatattcgtgtgccggtttacttcgcattccgagattaactccatcgtggcttctatagcttccggagcgcctattcaaacagacttattaatagccaccctctccgaatatgacacatttcgcctacatgatgacttcaacatcgccctccacatctctctcgcctgtttatcgcaaaagcgccgcaatgggaaagagccggcaaaatcaccggatcgaaatctgctatcgattatggcgggaaccttttctggaggtcggcgcggtctagccgggctgtatttacaatacgagcaaaaagtcaccgcggcctaccgacgtgtatatggggggtcgacgacgacagcgttctggtacgtgtctaaatttggaccggaagaaaagagcctggtcttggcgctacgttattaccttttgcaagctcaggccgaacctactgggattgctacgggttacgatttacaggccataaaagatatctgcgacacgtacgctgtacccgtagaggccaatcctaccgggttttcgacggcagacttgacatcgtttgccagattatcgcgtttctgttgcgtgagcaattatgccaacggtcccgtagctagggcgtttcccctatacgtggaacacagaattgcagccgacgtgacagaagtggatgcattgaaagagtatatagaaagagaccggtccgggttaaagatttcggatttggaatttgtcaaatatatttacttggcttacttcgagtgctacaatcgtgctcaattaagacgtcatttgcgagacgtgaccgtgcgttgtcccgaagaagatgtctacaaacgctcgtctctggggaaacacgcagtcgataatttctttacgcatgtgagatccagactaaacgtgaacgatcacatagcatgtaacgtatctccggatcaagtggaaatgggaaacgttttgacccgagcattttgtagggccaggacctatccaccgagtaccatggaaagcgatgcgcgtttcaccgggatttgcgaaccctcgtcggtgattataaagcgtctggatgccctagaatcgacattacacaaatacggatggccgcgcgcacggtctgaaacagttaacatgatgtcagagtgcgcgaatttgcccatcgcttcatctgccgatagtcttaggccacccggcctgccgctagaacatccaggcactcattgccggggtggtccaatgatcgtaaagcgcctactagcgctagtatccgcagatgcacgtgtcggggacataggaccgacaaacatgctcaccggcattcgggaatcggccgtcaagggccctcttccgatttaccggataggcatgtccaaaggcaaacaagcgtttgccgtgatggtggccgattgttgggacaaaatcatcccgtctccgggaattgtgaaagcccatctctctaaactcggcagatccggtagagcccccgaagacgatgtgatcgcccgagatattttttttacatcagaacttgagcgagtcacgggccatgctgcggaactgccgtactttacctgcggccctgccgaagaacaacagtacataaatcgcaacgaagtgttcaatgacaatcttattgtggggaacataatcctggatgtcgatgtgcacttacgaacccccgtacccgtcaaacttttgcatgtggcaatgagaggttttaggaccggtgcgctcaaagcgttgtctctattacttccaaaagcaaaaatagatcacggctcgtacccgtgctacttttacaaaacctcgtgcaagaaatctcgagtcgtgcacgtaaaacattggatgtcgtctactaccgacttcgctctcgactgcgacggtcccgccgtcgaaagtgcagactgcgaactagaaatgggcttcgatgacccgttacttatggatcaaattgatgattccatcagtagatgtgagtcagatgcatcaagtttgccgtcggacgccgatctgccttgtaactgtcacgaaaaaataggattgcgggtctgcattccggtgccgcccccgtatctactcgtaggtagcagaacaatgagcggtctggctagggtactgcaacaatcggttctgttagaacgtagtttcgtagaacctatcggttcgtatctcaaaaactatgatatagttgatagcggagtatatggtcacggtcgcagcttgcggcttcctttttttggcaagatagacgagaccgggcttatatcaggccgcctgcttccgttttgcgtgataccggagcgctgcggtgacgcagaacagttcgttctgtctcatttacagcctaaaacctttcacttccacagtcccatgcccgaagaagatcacgcgtctgtagttctgaagggcctaggcggagagtatgccggattctttgaaaaaaaaatcacgatcaatagagatacgtttttcggaatcagattatccttagcggtagctctgaaagccaggggggttgacattaacgactctgcggcaatcgtatcattcgtaacggagcacattttagatgacataattcagtacatgcatgaccacatacccgatcacgctgcggaatataatcacgtttctgtttcgtgctgcgtcattagaccagattggatcctcttgcagctaatggccaataaaacattgggacgcgctcacgggtttacgtgcgtgaggtttaagcatacaagaacgactcgaatgagttcgcgttcgtatttgtctttaaacatcgacgcacatggtaggttgtgcgcgtgtgtgattcagcagtgttttgcggccaagtgtggaaacaataaactccgtactctttttacggtggatgtcgattcgaaatgccaggcagaacatcgatagccctttcgggaattatactctgcatctcgacatacgccatcgctttggtgatctacacgacgatgatagctaaacacggttctgggtgcatctatgccgtcctggtagacagcgatcatcgcgatgccaaaaattttacatgggagccatacaattctacactggtatacacgccgctggggaataaattaccattggacggaggatttggcggttttagcgatgtatgtaacacatatctgatcaacgcgacggatttattcggacgcgcgtctcacgcgtccgccaagtcgaaaatccgttcggtggtaggaacgcgcaattgcgcagcctacttttggaagacgcatatacaagccttgaccttttccctaagttcgtacattatgttttgcgtcattagagaatggagacgcatgtttggggtggtgcgatctgaaaacgacagaataccgccgacgacgtacacgaagaattatactgccagggtaatcgctaacggattgctaaaaacggtatatactagaatgtctgaatttatgtgcgagattactatatacaaaaattctatgtgcagaatatttacagacgaccctatctcgtttatcttacgtcaccctttggctgcgattctccttataaccgagcggctcataaggctcggcgcacagtgtctgtgtgtactaacggtatcgattttttttgtaccgtgtaaaatagttttatcgaaatggttcttgtctatcaccggagttttcttaggaatcgttatttgcaccgagatgggcctgctgatagacccgggaccggctgaaaaacctgtcatgtttgcagaagttgccccagcccccaaaacccagcagaacggcgtggctgtcccgttcggtgcacacgctgtatgttccaattgctgcgcctccataatctccagcatagtcatcaaagttctgtacgtgttattcatggttaccctcatcgttaccctcgtgcgatatgaacgagcgctccagattgccctgttcgggcgtgcgtacctaccctaaaacattagtggccaagcctcctatttgcatcgcgcggatgtgacacgctaaccgcgagaccttataaatggttccaatgagtcattcgcccctcgggtgtacgcggtattctacagcagcgtattagataaactacacgggtttgccgtcgcgcctcaaggaaaatgtcagtgggagctttctctcgtgattgggacgatataatgagtttgtcagactacgattttacagaggaagaatccttagatgaaagcggcgaactgaaagaattcaagaacacgtccgcgttgaatgctattgagacagcccgcgacgcaattgaaagatcagccaattcaaacccccccatcgaagaaccgtcgttcatctccaaatctcatgcaggcgagacctcggcctcgaaatatagaagcttgcccctcgacatcgaaaaggcagaacggtgtgatgacactcgaggctacaacgtgagttcgggaaaacgaatgcgtttggcagtttcggccactgttgacctgtgcgagtctgagatcgaacggcaatgtctgaatacggaaacgcgggaccgtgcacggtcccccaaacattttgcatcccattatgaaatcgccgccaaaatacacgatcttcccagatctacgggaaaaaggcaacggcatcgcacgttagattctcgctcacgacgccacttagcgggagagcatcggcggcggggagctcatgacgaggaaagcagacacttttccctcagaatgcgtgaccctcattcagcacccggcaagagcccgctgtcgaaaaggcgcagtcccgttaggctccgtaacctctctgtgcaggaggaacttaacgcgatgctacaacgagagaaactgaagctcgacatgatttcgagagagcgcaatttccgcacttctagcaaaaaccgctgggcctcagtactggcattctcctgtaccggaaaaagtggggcatacgggtctcagataacgtggcaatatttgcttcaagagggaccggagcttagaaagacgttcgaaaatagacctagaacctcattgctggcgtctgcggcgcgcgaagctgtgttgcggggcgaaaacttagttgcggcattggagagcgccgaggaaaccctggcatggctgaaattacactctgttctaaaactgcgtttaatgaaccatgaccctattttcaggacggcgggtgccgtcttagataatctcaagctgaaactcgcacccataatgatgtgtagaaatggtacagacaaacggtcgttaggagacatgctgagaagatccgccacggacgatatcgccgattcattgaccttatgcttaattttgctatcgcgtattcatcgcatgatgatgtatcgcgtgtcgggtagaaaagatagttccatgatagatcctcggggatacatgagagagtatactcctggtgaatgtatggcgggtatattgcattacgtagacgcgcatgcaaaaacgtgttccgacagagcgtgcaatttatatattagctgtacccttatgcctgtttacgtacacggcaggtactttcgatgcaattccgcgtttgatatgtaacctactacagacgggcaattttgtattcttcaatagctttatttgatatccattaaacttaaataaagacaccgatattcaattggacatgaacagcgtgcgttttattttacacttagcctgtgtgctttcgacaccgagtaggaaaacgaaggacctgaaattgcacgcacgaccgaaggaaataagccatcgcaatcgcatttgaaatccaagtaggcaaattcaggagaacctatcacttcattgaacaagttctcgagtattcttatgaatgataagcactggagcccgccagggcgatcgcagacacaactaattaacatgccgtgagtgctgaagttctctctcatggcagattcgcataagtaaatagtcttccttcgagttcctatctccgtgaatctgcgggggttcatcagaagcgcaggtttgatttccgacgtgtgattagaatgaaattgtcgaaagacagtctttagagtcattggcatgtctgtcagtactatggacacttccttgcggcagcgatcggtaaggaaccacagtagttccttaggtagtatgtttctacctaggaaccacggtgttcccacggccaaaaaccaagcgtggtcaaacgatccggtgctcggagaagaacgctgcgtatccgctacccaaagcagtatcctttcgcagatagacgacgttgccgtgaccattctccctttccaacctcccgtcagtacactgtttattgggcccccggcgtgcgtgaggagtaccggtctagcgactattccataaacgttagtcggtgagagttctctcggggtgagccacattgggaagcccgtctgggttggagcgtccgatgtagagtcgtaattggcgcagcgctgaccctgcggtctacaatgcatggtcatgctagacgggacaactagtcgcccggtgcatttttcattacggccatcccttacgtccacgtaccacgtgccgtgagtgtgtaggtaacacgtagtgggcgtggaaaaacttatataacacccggcagaaaccacgtgcgcccagcggtggcagatcctcagttctacagtgtccaatggcggaaagtacagctgaaccgtcagcttcaccggtacgaattccgtacgtttggcaagtgatcgctccgttagcaattgacgtgccgtccgcctctactcaactagctacgggcgaacatgtgtcatgtgccgcatccgttattcctcgttcgtacgtcatacgggcagcgtgtaaatcgtcgacgactttccacgcgttcttctttggattggcgacggatccgtctgagaacatgtcccaatgcggtgcctcgtatatcgcgtatagaatgaacaagaagttacggactggtcgattgacaggcgaccaatgcgagtcgcctttttctcatgcgacgatcatcgactcactggatgaaaactacagcatggctatagagggactgtgttttcattgccactgcgaaaataagttttcgctcgagtgttggagatcggcttttagcgctgccgaaaaaatcgcatcgcagtgcagagctattcgcgagtacggacactgaataaaaacgaatcatgatttgatctaccatttcagcatttattggtttatacattctcgggttcgtatgtatacaaaatcttatggcaacccgcgataacaattcatttacgcataccaattgcgagagctaggggcgcaccctcaggttcgcctacgccggtatagcgttgagatctaatacgggagtagtgattttgcaggaatgtaagtggtagtaacacctaaagaaaaccacatactaacgctctactgttcactcgtatctacgtgcagtgaggttcccgcatatgtttgcgcgtcatcaatcgctctcgccagtatcgccacaatgcgtttttcgcgcgcgggtattgggacgcagtgtaagtggaatagcattccgcaggcaaaaaagttgtttgtcatgcaagcatccatcaagtagcaatcacatagtgggaccagacgcctcaaagcgacgtagtggggggaaccctcttcccattgcaaccactttcgaaatctgtaggtatatgctgccagccagcgccttgttctgacggttattaccctgaaccccttaaatgggaagaagaatccaaggtaccaatcgttggcgactggcccgtgcggacaacgggttaaggatgtgacaaactgtgtttgcgtgggtacgtttacgatgtatttcgaatcccgcacgacgcattcctcccagtgagatagtagtatcccataattcatgcatctgactaccttgggggtgagacacgctgtaatatgaggcgtcgcttgtaaaacgcacctgtatggaaccgttccgagttcggggattgattctatgatagcaagtctacttattccggaaaccgccatgacatcgcacaaaggaagcagttggttaattgcatgaatcagaatgtttgtttccagcacggcacctccaaaggaaaataatgtttcgatgcacgttcgtgccccgttctctgtattacagcttactagcgcaaggctgaggacaaaaacgagttcgggctttgtatgttcgagcggaacaccaatgcgacataccgtatcgcttaagtttttcataaaagtggatcttgcacgtttgccagatctgctccaatcggccgaaaaaaatttgcgcacaatcggatgcatgtctgtgcctacaaataccatgaaacataattcttgtgctggacccccatccccgctatctatatctacattgtctgacatgtgttgtgccgacaacaaacggtgtcttgtatccccatcaatccagcgctttctgaggtttacgggctttaggatggacacatcaccgcatttcggcacgcataacgcgggcatgtctgaacgggcaacgattctctctgtgagcagatcgagacggccgtgacgcacaccacgtgccggtacattaggcacgactgtagcaaaaggatggtagcgatggagccagcctaccgacagtcccgcaaaaaatcttatcggcggaatgtctcttttaaggggtagtgtgttacgaaccgatgaattcaatttctctgtccaaccacttatcgcttccgcaacagaaaaatcgtttctaagttgcgaatatgtttctaccacccacttgagatcgctgcgaagggcttccgacatttttttagcgtattcctcatctccatcacaatcacagtcgtgtctttcatttgcaagtgtgggcgcgcagatgtctacgcgacgacttaaccgagacactgtttctctagtgtaccggtaacatggactggcgcccgctctgaccgttagcatgcgtttggatgcaaccgaggttagataaacgtctggagaactgcccaattctttgctttcactggcacatatccaaccgtatgtatcctctgtctgtcctgccgcctcaaagttaccggggagaggtccgggactcgctagacagaagtcgatttgggaaaattctgtgtcattgttgtagggactgtgcggcctatctaccatagttgcagaatcgtgcattagaatttcagcgagcatggaatcgatacgttcgtcggcacccgcatatacggcacctattcctattcgcgtacaagagtcatcttctacatcaagcttccagaacgttgtcaggtattcgccataggctgcaaagtctgcatctgtggttcttcttacaaattcaatctccgggttccaacgtccacgtcccatacataggttgcgcaacgtgatcgagtacgccaacgtattgaaatcatttatgctagatgcttcgctattatcttcgaacaaaattatcgtatacaatttcgattgatgcatcgatcgaaggactgacaaatctgtcgcatatgtctcctcggggagaggtgtgacggtgataggctcgtccctacgttcgaaccggataaggcctactgtagcggtggtttcagtagtcctgatgcatcgtaaaattgtggcctcggttctaattttcccgagtaaggcccacggaggtccgcaattactattacacagggcctggattacggaggaagtgccagttggtgcacaccgaaactctggaaaccattccttggacggaataggagggtggaatttttgtcgtttagtccactccatctgttcgtacatggaaaatcgtgttaattcctgatcgtcgaaatgtgctaatggagctatagtgctgcgttcggctggtgcggaacctatagacacgacatattttggttgcacgtgcagttctctgagctgattaggaaataatactgcgtttgatgatagcaaagacctttcgggatcgagctccggagtgcagtgcgaagcgtgaacaattctacttttcttccgagacggtgtgaagcaaaacatcttgacgatgctacgttctatggcattctgcaacaataaagtatcaaattattttgacattatcatctatagtatgagcggtgtgttatataagaggacgaaacacttgtgaagtagacacgttttattcaggaactcacattttcactactacgctgttgtgagcagagagataagcgcggcggaaaaaacagtcacaaatactactgttaatataatgatcgcagccgcatcctgtcgggcattaaacaaccaatcctcttcatcattagtttccgaagagctagtctcataaggcggcggaggagagtcgtaggtaggaggtggtccatttgaggcttcatacggaggcaaatatgcagcgtcgcattgaccgtcccccagttgtaattcgaaatgttcatataccgattccccgggagcgtctaaaaatggttgctcctcatgtaacgcttgcgcttcgctcgtcagaccgcggtctagctctgcgctcgtaagttcggtttgcggtcggtcgctatccattttccctcgcccgcagtaactgtgtcgatggttcactactctcgaaggagttaaattgcctactttctcctcgaatctcgaatgtggctatgcagcatcagggtcattagcgtcagtattttcctctttggagtctatggctctaccccaaatacctcccgcgattgctcctgtgcataaggccataaacaggccggccctctgccaacccgttgaatccaccttcactgctctgccaattagtattcctgcaaaaaatgccatgcatgatcccattactaatgatcttgcggaccgaataagcgtgattaccattaaggagcgcattgtagcattctcagattccacagataaaacagtacgaggtactgtaggagcaaggcgctgacctacgaggttttgttgcacctttcccgctcctttttctgctatcatcagtaagttaatggactgcacgatttcgctttcggcccggaggaggcggcgggcatcttgtaccgcgcgctcggcgcgccggagcaggcgcgcgtgcgcctcgtccgcgtccgcgcccgcgtccgcgcccgggtcgtcgcccgggtcgtcgcccgggtcggcgcccgggtcgtcgcccgcgcccgcgcccgcgtcgtcgcccgggtcgtcgcccgggtcgtcgcccgggtccgcgcccggtccgcgccctccggcgtcgttctctccggcgtccgggtcgccccctccgtccccggctccgctctcgcgctccgcatccctctcggcgtccggaggggcgcgcggatcagcggtcgggtcgcgatcgcgtccgtcggatcggcgccttttcccccgccgcatcgcgttccgccgggccggtcggacgggagaagaagggggagggggggaaggaggagaggggggagggagggtagccggccggcctgcagttcgggaagagcgggggaggcgccgtccgaggccgccggggaggaggttgtggggggcgggaggatgtgtgggggaagggaagggggagacggccgaaacctacgcgttcgccgcggcgtccgatccgggatcgctcccgacggggctctcgttcggcgatcgcttatcctctgccgccaccttgcgtccgttcgcgggaagcgccggaccggcgctctaagcggagatccggcgcctccgcttcttatgaccgggccggtcgtgagggcgtaacgatcacgtgatgcaatgcaaacgagcggggcgaacgcgtcagcgttcgcaccgcgaaccaatataagattatatatataatatattattggcgcaaggtgcgaacgcccgtccgggccaatcgggaagcgggatcctatgccacgtgttcgtgtccggccgcggcccgcgccgggggctagaaacgccgcccccctcccacgggggcggattcggggacctccggcctacaaatacgcgagcggaggtccggcggggaccgtcgttccgctggccggcccgccgtccgaaagcgcgggaccgcggtaataaagcgcccgccgtcgcggatcggattttctggtcgttcttttaccgccgggcgaaccgcgcggcgaacgaacccgtcccgttgggatcgcaggcggccgggaagcgatcgcgcgccgtcccgagaacgtcgtctacggctcgcgttcgcgggggtcgccgacgggtggaagggggatgggtaccgagggcatcgaactggccgagctcggcatctccgccttcgggccgcgaccctcgcggcgtccggaaccgtcggacgtcgagggaggacgccccatcgttctcgtccgcggatcgtcccgatccctcgcacgagaacgagatccgaccccgcgtcggcgacgcggccgaacgccgctcgcggaacacggtcgcgggtcgccccccgactttccccccggccccgcacccgcggcgaggtcggaacctcgggaatcgattgaaaacgggccggtcgagataggaccgctctctcgttcggaagcggagcaataaagccgttcggcgtgagctcgggatgagtctcggacgcgcgtcggtccgtttctgcccttgcggcgctctacgaaagaacccgatgaggccgcgttctgttcgggagcggtcccgagctgtagggatcggctcagtagtaactcgtctcgggtttcgatcgagttctagcgaaccccgaaaggggggtacgaggaagcttgcggcctgccgcaaaaagactccgaggagaatagcttatccgcgatacgccgccccctcaaccgttcagcactcacttcggcgtcagttccgaagtgactttgtctggccggctcggcgcgagccggcctcggagagaacgcgtacatagcgatcgtgggctgggcaacgagataggagtagagggatggggaaaaagtgaagtcccgcgctggctctggacgaggcggaacgaaatgggggaggggacggcctctcgaacgagagcgggggtggggcatggtcggtggaggggtgtgggaaacgccgcgacgccgcggcccgtccatgtggtaatgcggggaatagagttccctgacggggaggagttgtcagctcaccggtcccgtgatcaacgcatatgccacatatatgcaaccccgcgaccctctcctcacgaacagggtagagggtctcgctttgttgcacacacaagcacactcacttttgcggcgacaatgaaaatcgtgagcccagaccaattgcccctatatgtgttaacggcctccgacggaacaacggagttcagtattcgagattggtcgctatgggatcgggatccggaatcccgtgcaggtacgcaccgcgggctccgtcaaacggaacgctctcttttggagcgatgtcgtttgggtccgggcccgagtagggttcggccggctatttccctcccccccccccccccaagcccgtgcgggaccgaggttgagtgggaaggtctcgcctgccggatcgggggggaggggaaaagacgtttgcgttatccggaatcgagccggaccgttttacgtttcagagttcgaacacgctctcacgagctgcagccaccggctcaagccctcagaccgcgtccgcgccccgggccagcctagcgtcgcaaacgtctggaagagtctgtggagtttggtttcgagggccgtgcggggaaacgcagagggctcctacggacgaccggaggagggagacgccgaaactgccgtgtaaacgaatgcttagcggagccgcgcccgggacgcgtcgtttcttgcgaaacggggtggatcgctcgcccgctcttagccctcgcgtacagtgcgtcgatcgttaaggtgtacgtgcgtgtacgagaccgcgtgcgagcggtctcgtcgtagtgcgtatgaacgtgtttattaaaaagtctttctcgcttcggtcccgtttcggtgtctggcgatggcgcgggcgggggagtccgtcgcgtaagtcggggaacgtactttgtcctctcctctcccccgaggcgggatgtgcgagggggggggcgacgggcgaccgggaatgcgtgcgattagtgttgtggagaacgtaccgcgccgaggcccgcggtgcgcgcgaagggttagttgggggaggggcacgcgcatcataagtcgctcgcggatcgtccaggtgtttgtgcgggggatacagtttcgcgacggggaggagccgttagctcaccggccccgcgggagacgcagatgcgatataaacagccccgcggtccacctccttgttcgcgacctgctacttagcctcgcttcgttcccacgtataagcaccactgacttacgcggcgaccgtggaagtcgcgagttccgaccagtgtcgcgtatatgtgttaacggcccccgtcggaaccgaattccacattcgagatgaagtgctacggaatcaggaatcccgtcccggccgcgcgcacacccacacacacccccacacacacccccacacacccccacacacaccgcggctacagagcggctgtcgtagtacgtataggcgcgagcgcgaacacttgcacggactctcgtcgtagcacgttcaaatcggtttattaaagccctcatgctcagactccgtgtcgatggcgggggggggggggtggtgagtgacacgaacttactttcctgcgacgctcccgagaggaggtgtgcaccgggccgttttctccgagactgaaaagagaaagaaaagctccgccgttcgcccggccgagcgcccggacgcaccggtgtccgtacggccttcggacgcttagagagcgcgggcgtttcgcgccgctgcggcgtttaggcgcgcagcggcgcgtttgcaaaaaaaaagaatgtacggagagacccgcccgccagcctctccggcccggagcggaaacgccgcgttatctctacgcccccgacccgcacatccgaatgcgcggtcggatcgcgaggttaactccctgcccgcgcccgcgctccgcgctccccctgcgttgtttaccggttcgcgatcgcgatcgcggaagtcgcagggccgacttccttgtttacattgaatacgtcgacggaagcgcaactgcgtatgtccgccgcgcagacgcagaagcgccggggccgaatccgggaagaagagtaatacggggcttctccagcgcgtaagtaccggcgttccgggcggtcggcgagtcggcggagaaaaggtggatcgcgagcgcgatccgaatccgcgggccgaggggaaattcttcctatcccctgtgcgttgagcgccccgtgccgtgccgcctttttccgtttccggtcggactcggagccttcccgccgcacggttcggactcccccccccccccgcaacggttttattttcccgcgttcgaccccggcgtgatgtccgcttttctgttaaaccgtgcgttcgtcttatagggaagccatcttaattctgacatgcgcgaatgcgtctttcccccttccaaggcctaaccccccccgcgctttctcgtttccgccgtgggccatttatcttcccccccgcgtaaacaattatccctcccccgcgcgtcctacttttcttctgagacctatcgcctttggcgattctagtcagattgccttttatagtcaagtttcgagcagatcctaagcaagcatgccctgtaccccaccccccttctaaataaatttccgatccctggaggtttccggagtatttgtcccaggagcggggtcctatgcagtaatcgtaggtctttcatgtatgggggggggggagggggggggagatgcgaacgcccacactggtgttggttcgtccgccacggaagctggaaccccatcggacgtctcggcgccctgtttgcaaaatgtcaggtacttgtagtgcattccacgtaggaaaatggtcgtgaggggagggggggctgagtttttctgttatgggtatcctgaggggtctacgtgaaagtgactggccttccgttttcccacagaaacgttgtgtggtacggtgcaccctgagagatgatctatattctcaggaagttccgtgcccgaaacgctctgaacgataagcttctagattgcatcggggattcctctgagaagagcgggtggggaaatacatagccgttaaagtctcgcggtccgatatccccgtttggccggtggatgagtcgcgatggccggacggggccggaaatgcgatccttcttttgcgggctatttgcgatggaagggaaaggcaaaccggaaaacttaaggccgtttggtgtgtttttcccttccatcgcaggtcgtgccgcagtacttttgaatcggagggagacgtcgggcgagtgggaatgggcatcgcggggtcatcctttattctgggacgaccgcgaatctacgtgtcgtctcagtctggacggcccatggaaaaaaaaaagagtcgagaggcgtggggggggggggaggcctgaacggccggcgcgataagggatacgtggtcaatcttggcgattaagcctagatattgcgcggggagtggggcggcggtccaatgcctagaagggcattattcgaaatttggagtcgggctgcgtagcgacgggtggcgcgcattaatacccctatcttttttttttttgcttcgtttcttgtggccggcttgggaaatgtcagcggaaaacatgcacccgctgtgtgaatgtaaaccgcgtaagtaaacccgtgttagactagatttcgcaagttgcgaaggggggcgattggggaggaggaagtctgaacggaggggggagaagggaggggggagggggaaggctgaacggaggggggagaagggaggggggagggggaaggctgaacggaggtgggagaagggggaagaagggagggagtggggaggggggggggagaagaggggaagggggaaggggggaagggagggggggaagggagggggggaagggagggggggaagggagggggggaagggagggggggaagggagggggaagggaggaagaggggagggggggggaagggaggaagaagggaggggggaagaagggaggggggaagaagggaggggggaagaagggaggggggaagaagggaggggggaagaagggaggggggaagaagggaggggggaagaagggaggggggaagaagggaggggggagaagggagggggggagaagggaggggggaagaagggaggggggagaaggggccctggcgagatcggctctgaattcttcgttgtagatagcagacgaccgtaaacctgaagtacctgtgacttggacggtgatgagatgtttggcctagttacagggactggcctttgttagacacgatggcctttggaaacgcatccagtctgttttggcatctgagtggcgcgtagccgttgtcagatgccagagagactgaaatgtttctcgaggactctaaccgtaatctgaataggcccggaccttaatcccaataggccgtgccgggatatcagaggagagccgctcggaccgctgcgattccatccttcgactagcgacttgttatggcgggtaatagccggacgacggagtctcggcggttcgaccttagcgggccccggataggtttctcggttggggacaaaggggaggtagaggcgtcggatgcggggcgatgagcgggtatttaggccacgagatcaggtgttgtgaggaaggggtaacgacgccgtattgcggtcggaccgcacgacggcgcgtcgtccagtccttcccgggtcccctagaggtgtcacgttctaggacaaccgggacggacagggcgacgcgcgcgaaatgcctcgtatcgcctgatatgctcggaacgagtcggggaagggcgcgaaagcgagagttactactcggaactcgggactgttcgtatgttttctctcaggctggcattgcacgtgtcattgccgttgtgcaatgcctgcggagagaaagacgaattgattccccgtgccgctccccgtcgtgtgggacaaggttgggagggctctgggcgaagaaccggctgagcatcggcgcgcgcgccgtgtcccccctcggcggtgtgcacgggagtatcgggcgccgtcctcatgcccccctccgagggtagcacgcggtggtcgctgcggtcttttcaaaacaggttctgcgaagcagagatgcgtcggcgcgcgagcgaagcgaaccgagctctgctccgtccttagcgtggtgcctgagattttaacacgtatcgtctcaagtactgcgcgcaaggaccgaggcggcgttccaaacgtcggacgggacggcgcggcgtcgtcgcgcgccgcggaaatcgttacacgctccgcttcctccttcgcggggtgcttgagatcaccgaatgacgggatcgagcaccacgccgatggacggagatggcgcgcggtacgttcactgaatcgcaacgaggccgggccgcgctgcagggatggccgcgggtacgcgcgccgagtatgggggggcgcgtgctctcctacggccgactcttgggagcgtgcatcgttcgggggtcggctgttgggtaagacgtggtctctttcaggtcggtgctgttattttcggcggggcgcgggacttcgtcctgggccgtcttacacgcacgtcactctggtcgtatcggtagtcctagtggcttgcttgtaggctgtccgtcggaggaagacagcaccgccgcccagctgcctgtgcgagcgcaggactcgtgtccacgtcctgcgtgactgttcgcccgccgttcggatggtccgtggtacggtgtcctgtgttgtgtgagaggtctccgtacaccggaccatcgaaggggggtgggggggatatgcgaccgcagagcgacttttaggctgccgctgtgcagtgttcggttgggtggggagggaggaatgtctgtaaatcttacggcgatatgctggatcgtgagaggtgagtacgtgtctgtgcgggtaggtgggagcataaccacaaaaagactagaattctgcccgcggggaaatggcggtgtgtgtaatgcttctgttccaaacgaaggtgcggaataggagcgaaatggaccgaccttcccccgcgacgacgtaagtggcttgttacgacctgggaggcctagctgtgttctcgctcgttgccagtggataggctcgcccttttttgtaacagatggcgatggaacagaggttcctatgtgggggggggggggcgggaaggataacgtctatcgatcccgaagtcttcgttgcggatatgagacgatcagtactctcaccgatctgcatatcggacgcggaggggcgagagagggcccgtggttaggcgtctgtactccgaactgcttccattttttcccttacggtgcctgacgtcgtattttaacggttagatgccgtcagggaaagatgggagtttgtttgctcgagccctgccggcggactgcaggcgaagaagtagccgggcgcgaagcggctgggaatcgggtcgcgtggcgtgtcctccttcggacgagtgcttgccggggagtaaccgtcatgcactactccgggggtaggacgcgacgtgcgacgcgctctccggatcggtgccgtgctgcctgagatcgagagcatcggacggagcccagcgccgtcctttgtgctgtgtgtgagaggtcgtcatcccttctcgggcaccgcaccgaaggatggagtgggccctcgaaacgtcatccggaacgccgcgggacgaagccgccccggtaaagtccagacgcgcgcagttccctccttcgtccggtgttcgaggcgtgagacttttgtattgccgcgtcgagcaccgtgctggaggaaggagatggcgctctactccgggacgaaggcgctgcggagcgcatcgcgtggtgttagaggtggatcctgtcatcaagcaccacgtcgatggacggagactgggcgcgaagcgttctgcgggatcgcgtggaacgagggcgcaccctcggtcgcgattttctcgacgcctaccctcggcgttgttcgtcggccgagggtaggcgcagaggaaatcgcggtcgctgtggactccggtgtctggtatcatgtccggctcgagtcgtacgtcctgaaatgttgcttctgattccgacgggtcttcttcacgtacctctctatggctgcatctttatggccatagtgaggtacgtgtaggctacctgccggagaaaggcggtcccgacgaatacgcgtcccgtgtagcggtcgcccgctctgcgatgggctggttccggcatcaatattgcagggtctatttttgtggtgggcgtgaccgcgcatcgcatcgaaataaatctttaaaccggccgagttcattgttgggctatgctcggttttcggggggggggtgtggaaggagggtactaggttagggttagggtcgggcccttagggtcatggtcagggttaggcctttaaggtcatgcttaggtctttaggggcagggtcgggcctttagggtgatggttgggcccttaggggcaggggctcggggtaagggttagtgccagggtcgggtgtcagggtcatggacagggatatgccgttaaggttagggttggggtccaaagttaggcgtttaggggtcgggtcgggttcggggttaggcctttaggggttgtgtctggtttagggttaggcctttaggggcagtctcggggtcgtggttaggcgtttaggggtcgggtcgagttcggggttagacctttaggggtagtgtcgggtttagggttaggcctttaggggtagtgtcgttgtcggggttaggcctgtaggggtagtgtcgttgtcggggttaggcctttaggggtagtgtcggggtcggggttaggcctttaggggcaagctcaggtgcagggtcggggttaggcctttaggggcagggttagggtcagggtcggggttaggcttctggatcgggtctttagggtcggggttaggcttctggatcgggtctttagggtcggggtgattatgatcagagactaagagcgcgaaggcctatcagtgttaggttctctgggtcagggttaaggcctcggggttagggtctcaagggcggcgtttggcttaggggcccggggttaggacctgtcaaggtcagggttatggcctatcagagttcgtggtcacaggtgtaagggttattagggcctattaatgtcaggccctattcgggttaggctcccaccgagtactaaggttagggtcttgtaagggttggggcccgtaagggtaggggctggggtctgttacgggcagggccccccccacacggttcgacctgccacgcttaggttcccatcccccctcccccccccgagtagggttagggcctggcaggggtagggtaggcgcgaaggttgggcccgttagggctaggagcgaccctcctccccccccccattattgttagtctgttaaggaggcgttccccctccccgtcagggttagggcctgttaggggtagggtaacagggttaggttaggggttaaggtctctcggaattagggcggggcgtgtaatggttatagggtcagggcgtgccgcggattgagggtcggggccggcgagggtgtcgttccggtgtttacggaaacggcggatgtgcgcgcatgcgctcgcgcgcgagccagacggacggacggacggacgcgtctcgtagcagcattccatgggcgtttttattcgtactggccgacggcttcagcccgggtcggggctaggagcgcccgcgtgcgcgatgaagccgccgtctcccggcggcgacgcaaaggctgcggtccgcggttcccaagcgtcctgcgtccccgccattgctgcaccgctgccggaaaaagaaaaacatcctgtacgcacttcccgagcgccgggacagaggcggtctccgccagccccccgcgaaattccaaaaagccggtgtggcggactcggccatggaatctacggggggggggttgagggggggatgcggcgctgtagtcgccggatgcagtcaggacacggaaattaagcgcgtccggacgtgccggacaatcgcgtacgcggaagtgcttgcacgggaagtaaacagtggaccgcggcttaccttcccagcaggagtacggtgttcgcggagaaaactgtaaggcgggagcccatcgtcgtgcgctcccggtcctctcggaatcggctgcgagtctcaaaaaaacaggaaaggggatcggcctcacaaaaccacttcctcattcgtgactgcgcgtagcctccgttcttgaaagcggttggcgttcgcacagacctgagtcgacaccgcctacctgttgtttactttcaatgtagtgcgttgcacagagacgctcggggccgggtacaagttgcccgggtccgcgggtctgaagcacgcactcttccgttgaaggacggggtgggaaagcggattattggaccccgcgatagggtctgttagggtcgggggttcggcctgtcatcacggtcggggttagggcctgtcttattcgttttagtgcctgttagggccacattaagggcttgggccagggccgtttacggtggcggttagggcctctcggggtcggcgtcaggactgttagggtcactgttatggcctttcagggttagggtaatagtccatagtcggggtcaggacatattaagggtagcggctttggcggttacggcatgtagggctaggaccttttaatgtaacgggcagcgttggtgtcatgtatcacggtcggggtgactgttaggcctcgccgggcctcatttcacggtcggggctatggcagggtcagagtctgtggtggtgtgcttcggtcacccactgtgtccgcgcaatgctgcgcgttcattctgcctgtagccgacagttcgcggggtgcggcagcccgcgggctgagtgcacctgtggcggcgggaggctgcggcccagccgcgttaattgttgtgctatgttccttttttggggggggggtgaaatgcagggggggatattaagttggttagggttagggttagggttagggttagggttagggttagggttagggttagggttagggttagggttagggttagggttagggttaggccgttagggttagggttaggcctttagggttagggttaggcctttagggttagggttagggtgaattttttttattcagttcgccgccgcgagagttttggtatgacgtttggtggtggccagggtccgccgcgcgcatgctccctacggtccgccgcgcgcatgctccctacggtccgccgcgcgcatgctcgctagggtccgccgcgcgcatgctcgcaaatgtcgactgcgcgcatgcgcgcacgggtccgctacgcatttccgggcggcctagcgagcgcccgcgcggccggcgggcatgtccggcggggatgcagcgtgcggctcggcctactggccgcgcggagccgccggcggtcggcggtctaacgcttggagtcgcgccccccccccccccccgatcagacgcaaggctttttcaggcgcccgtctcggtcacttaggacagccgcggttcgtctcgaaaaaggtctgcggcgtgggtggtgggggaaagggggaggggcagaacagtccagagaccgtcacgggcgaacgattggggtccgcggggggcgcgaggtggactcggtagccgccgcggtccgatccggaaaccgtgtcccccctgcgctttcttcgggcccgctcgccgacgcgaatggggtgggggaggggggtgcgcgggcgaacaattagggaccgcggagtgcgacagcgggcctcggtagccgccgcggtccgatccggaaaccctgtcccgctgccgctttcctcgggcccgctcgccgactcgatcagaaacccgtctcccccgccatttttatgtctcccgtatgcgcgctcgttcccgccactttctggtgccgctgcggaagaggatagccgggcgggcgagcgggcgagcgcgccgcggaccgaaccgctccgcgggctgcgcaggggaccgcagagattgctcccgcgcgagggatcgatccgcggggtagagggctctccgcgaacagcgtaagaacagaggtgtccccgcgcgccgctgcctccggacgcaccccccgcccccccccccccggccacccagggcgaccgaaaccccctgccgccgccggcaagagtcggtcagagagcgcgaatgatgtctgtcgcatctggtcccttcattcattcattcattcattcattcattcattcattcatttatttatttatttattcgccagcgctacatctcaatcccagctaccgttaaccctaccaccacccccccccccccccccgaccttgagcggttctatccgttcgagatgaccttcacggagcggagctcgttgcaggatccggaggagcggtttccgcagccctagggatcgcgattcttcggtacagccgcgcaggccttcggaaaggacgcggcgatctgagtccagggggccacggctccgcgcccgcggtttcggttcccgggcagaccgccgtcggggacccccgggagctttcggagaaggtagggcggagttctgaggcttgagggacaatgagcggcgggtcggttcggttcacgtcgccgtcgggatccggtgcggccccgtccgactttgccgtgggaggctccattgtccgtcccctcccccctttggcggagcgcagggcgaaaggaccccgctttcgccgccgctcctcctcgtacaggccacgggtcttctaggcgctgtcgccgcgcggtcttccttttacgaaactttctctaccgcgtttgcgggagaacactacggcgaacgcgcccgcgggctcgccggcgcttctgcgctactgaatggccgggcgaaggtgcgcgcggggcattcgttctgggaacaggtatagaggcgtggccacggccgaccaatggaccaggcggtgacgcatccgcacggcagaccgcggcccgtacgactaacagcgcggaacgcaaccgagccgcggggttccgctggccccctaatttatttgtccgtctccccgctcgcggatgatatgtcgtacccgcggggctgcttgtccagatagcccttaaaagtccgccgagtgactccccccgcccccccccccccgaccctgacttagccttcactcgccgaagacttcagagtcgctgagggccaagggcgaaggaggaccgggcagcgtcggaggatgaattatcctctgtcgcgcgccctgttcctcctggacggtggtctccggcggaccgccgtccccttccagccacactacagacgagctacgtaggtgagcgagcatctcgcgggccaataaactgcacgtcgcttcgggaacgtgaacgacgactggctgggcgtgcggatcgggggggaggactacggagcggcaaacgtcgcagacggtcctatttaagaaatcgggggaaactatggcgttctttttgggctccaagacgtacacgggacgcagcggggcgtacagtccccacttgagagcggctcggtgggagtgcgactctccagctaaaaagtcggggccgggcggcctctggcgcccggccacaagggccgaggaggctgcgaggtaggagagagcggtcattgggaccgtcgcgacgcggtccagtcgcgtcgcgaccttgtatcggacgttgcttccgcagcacagactgatgtcgccggccgcggggttttcgcggcgaaagtgcgtttccagctcacgtaggaccacggggcccagcacgtcccgcgaggttatgaccgtcgtagctagatcggggtggccaggccatcggacggagcattggctgcggggcgagacggtgcacctgacgtagcggacggcttcttccacgaggcgcgggccgttctccgggcgatcttgatcctctagcgtgtccaggaccacgagccttttttctcgtttcaaacagaggcgttgcaggtgttccaggacgcccgcaaaaccgaggtcctgaggggacaggaacatgacgccggccgcggtcagcgccgaaacgtccggcgccgctctccaccggcccgcccaggcggcgctctccggtaggcagaggcggttggcgagtgcggcgagcaggaaagagagtcctccccggttcgggtcgaaccggggtcccccggggggcgagccgggcgccggtacgcaaaacaggtgctcgcctgggttggccgtgtacaggatgacgagagcgacatcttcaggcgaagcctgctgatgccgcatccaagcggtgcgcgctctgagagagacgacggccgtgcggcacaacactccctcggacgcagcagtgtctgggcttctgctgacgtgcgagggagtgctcgccacgcgagcgatctccgccatggcctccggagaacgcgccaacggctgacgccacagagtcggtatttgggcgaagctggtcagctcgtcgactccttcgcctggacaataggcgtcgaggtgcggggggccggcatagccagcaatcggagttccaatggggggcttcctaaaggcggcgccacgatgccgtcgatcgcctaacgacagggaaccgtccataatgcgcgcggggtcgcgccacggaaagcaacgtgggcgcttgggcgggaaaggcccggcgtcgcggcacgcttcagggggggtggggggccttgtgcagctggcgacaggcggaggtccggcgcctgtccgggaccttcccaaacgcggacgcgggttctcgacggcgttgtccgcgccgtcgagaaccgccgcgggagctgattttctcttccttgactcggctgacgtttgggcgcaaagggcccgcacgggctcgggagaacttgcggggccggggtcgtaacaaggctccgcggagcgcgaccggccctcggacgttccggaagaggccgcgtcggcgtccgcgagaaggcgcgccacgcgttgcagccgtcgggccttctcgcgggatcgtaccggttcgcccctcgacccacattcgcgcaggagcacggaagtaatgtccctcgacccagggcatcgccaaggccgagcggggtctttgctaagcaacgggccgatcgcttccgttatcagggccaccgcattagccgcgagagttcgctcctggcgcccccgaggagccgaaccgttcgcgtaggccgcgtacacggcgctcctgagatcaagcaggtctcggagccacgacccgagcagagcccggcatttttcccactgttcgtggccggcgggtcgagggaagggcccgtcctcgcaagacgacagcatttccgcgaccgcgcccggaccgtcgggtccgcgcagaagcgccgccacgaccccctcgcactccagcgcgcaagcgtccaccagctcgttcagcggccgggtagacgcgaaaccgtccccggcagggatgtccggacgcgcgggcgcgaccaatcggtattcggggacgtccagcaggccctcctctagcgcggaattgaaggccgcgacgccccggcgcacgcggtcgtggatcgtggacacgtctattaccgggatgagcccggccgccgtactttgggcagtgacgggtgcccgatttgaaataggcgatgccgaggggcgtcgcatttcggcgctggctgcagacgccataggcgcgtaggctttcctgagggagcggaacatgaactctttctgatctttgcagtacctgcgagtcatagacacgctggcggcgatgtgcggtagcgcccaaagcagatttcgcttcttcatggcgctggctatgtggggtatgcatttgttgaccgtccccgtgacggccgcgcccggcgaactgtgcgagctctgaaacttcgtgacatagatgtgattgagcgctgcgtcggtgggcgagagcttgccgtggtgtgcccagttcagggggttcgccttcacgtctttgttaagcatggcgcttacgagcgcctcgtactgtttggcgcagttccccatttcctccacgtacaccgggaggggaccgggagtagagaggaatctaacggcggcctgctctacttcagggatgccccggagcgcctgtcggtgtccgccgagaggcccgaaccagcaccggccggccggcggggagggaatttgccaccacacctcttggtcgaggtcatccggcggtggcggcgcagcagtttccgaggacggtgatggcgcccgccggccgcggccgcgccgtcctccgcggccgcggccgcggcctctggcagcgcattgaggcgctcctgcctcgcgggtcggcgacctggatgaggtgcgcgaagaaggggcggcagacgactgttccgatgaagagggcgcggacgacgaagaggacgaggaagaggaagcggacgaggaggaggaagatctggagcgacacccgagcgaagggtacgaggccgggggaggccggggtaggggatgggaagcgcgggtcgccggcgtgccaacctcctgttgtaatgcctgttttagaacagcaggtggagctgttgtgtgcgaaccatcggagcccgatcccggctggactctgcggtaacgttcctgcgtaccggtggggctgctaacgaggcccggcctcggagacggcccgttccagtctggaacgggaagggggggaaacatgggcgctccgtcgtccctcgcgccggacggctgacggaggtgtctgaatcggcgtagcgccgcggcggtgacggcggcgcgccaatcaagtatggctttgtacagaggtctgacccgtttttcgatggccggaccgcaggcggggaaccccagttcgaccatagcgacggcgagctgctgcaccatgaatccgtaggcgcgtgcgggacgagagccgtggggcgtcccgccgggttccggatttccgttccgcagcgccaacttcgattccctgacggccgcggaaagcgcgggagggagcgcggtggcgggcggggggggcatttcgaaaggcacctcgaagccgggccgcacgtcggggccgacgatgtagtcgtctggggccagcagtaacccccgacgcactttgaaaaaaagacacctgtaatgtagcatcttgaaatcgttccaggtgagcccggtccaggggttcgggctgccttcccggccttccacccaccgaatctcctcgagcagaggacagaagttggaggcatagaagccgccgcggcgccggctgcagtcgagaccgcggggggattcagagggcggcgttccgttccagtcctcgtccaagggagtacccgcgcccggcggcggcgcgcacgccggaaagcacggcagaccacgagccgcttgtaattgataggaaaagtcgcgtgtcagaacgtgggccatgtactggacgcgcctgacgcagcggagtcggtccagccagcggtatgaaaggcggggaaccttcgacacgaaatcgggggtgacttgaaggccgaggaagcgaaggagcgccgacaaaatgtaagcgtacgtcggggtgcgcggagccggtctcgggagccgtgttaccgcttcccagatgcgcgttggcagcactatcggggcggggagggggagcgggcactcgttctgcgggccccatccgcaaccctgcgattctaacacgctttccccgtcctcggacggcgacatatcgtccagggtcgagagaacgaggcgcgcgcatcgagaaaacaaccacatcttgcaggccgcccagtcattccccagctcgttcggagggcacgggaagaccggctcctggggcagcgggcgacccttcgcgcaacgccattcgaacggccggtagtcgctgtcgagtaaaggggcctctctcggcagttcgatagaccccggtgaggtccgcagagggctgccgcgcggagtaggtaagatttctctgagtaccgcttccctcgccagccgatcccagtaggaagggcaccggcgagcgtccgacaacgcgaggagaaaaaccttagggttgtctccggaggacggctccgtcgcgccgtcgcgagcccccgcgcgccacaacatagcgtggctccccggctggcgggccaccaactcgagctcttctcgagggggggatgggatcctggcggatgcggataggcggcagacgtactggaagcccgcgcccctggtacgggggcccccgccctcggaaacgctcgatttacggcgggctgggactcggtcgctccggaggggagcgggtgcgaggcggggggctgaaggggacaacggaggggaaggacgctgacaagaagcagagagggctggggggtccggggaaagaggcctgtcgtggagaggggttggcggaggtggggtagacgccggaggcgagtcaagcggtagagacgcagacggggaggatgtctgcgtagagggaggggaggtagacggcagaggcgtggggggaggggaaccgtgcggagggggggtatgcggaggtggcgtaggaggaggggggctaaggggaggtggcgtaggaggaggggggctaagggggggtggcgtaggaggaggggggctaaggggaggtggtgtagggggagtgggtgaatggtgttgagcgaacggtcccggcgtcagcggagaaaatgtccatgggaagttcacgataggttcgggggggggtggggggggcacgcccgagggaggggggagagtttcgacacagacggcgagcggcgtgcaggcgccggtgggcttacagggcgcgtcagatacgcagcggacggggtcgtttgatttgcggggatccatagggctcggttcgccccgttccgaacccgcggggactagatcgccgactgtcttttgccaagaacaggaccgcggggccgccgcggccgtttcgtttccacagacgtccacgatgtccgcggtggaactgacgacctcgccaggagacccctgatgcgcgccgtcggggggttcggcggaacggagacccgtatccgaaccctccgaaacggcaccctcaatgccgaaaggggctcgtgcgccggcaaggctgcccgcgacgggagccgcgcgggcaggggatttagaccgtggcgggacgggctgccgaccgggcgtcgggggcacggccacgctcggtgtattcaagcacacgtcctggtacggatctcccggggtggcgggtggctgcggagaaaatccgccgttgtcggctaacatctctaacaggctgtagaaatcgggcgggttctccatgtccgagcaatgggggaaacgcgcgccggtccaaccgtggcgacgccggcagcactggcgatccgctccttacaggggcgtaaatgcaggggttaatcgggcggatggggaccagcgcagggagcgcggaaggagtcctgctctgaaaaaaatgagggggaaccgtgagaaagcgttccccgcagttcgcatcgcttcttgccccccgcccaacaccaccaccaccccgcccctacacacaccacagccacggctccggcagtgccggcctggctactcctttaatcattaactcccatcaacgcgatttgatccccgggctgctctccgaatcagccgagccccataggtaaacattccgccgcccacaacgtttcttgtcaaacaaacgcttatcggccggattgcgaaacgagcaggttttgccattagatatgctgcggtcagcgctgctaggctccccgggggcaaacattctcctagcgacgccgaggtaaggagacattaaccctcgacacgctcctgcgagcgactgtgcggttcgtgcggtttgtttctctcgctcccgacgttcctaccgccctcgggagagtgctcgcccgggggctagaacccgaagcggaccggcccttgagcatcgagacgcttaggctcgggcgaaccgcccggctctaaaaagtcaagcgcgcgcgtgtatttcttttttttgggggggggggggggggtggtggtggtggttggagacagaagaggagagaaacggagggggtggtggtggttggagacagaagaggagagaaacggagggggtggtggtggttggagacagaagaggagagaaacggagggggcggtggtggttggagacagaagaggagagaaatggagggggtggtggtgggagagaaataccgacggccggacagagcgaattattaagcacccaacgctcacgccaacacgtcccacctctttccccgacccgcgccgccccccccccccccgatattcgcgtcgggggtcagggacaaagagaggcgacggggcaataggcgctgcgtgggggagggggggccggccctacttgcccctaacgcaccggcgtccacgcgatcgcgcgacccgacagcacctaccaggagcgcggtgccggcggcagccccttctcgattcggctcggagctagccgggagagacggccgcggtcacgtctccctttccgaacgcctagcgatatagttacagaccgaagcgagccgtgtcacaccaagtcacttagccgcaattctgttccccttcccccacacacataacaggagacatagcgcatgggaggggctttccttatctctcgagcagaggtcgccgacacgtcaacgaagggcggtacgtgtgtggtaagtagcagagatcggagttggtcccgatttactaacatctaataccgatcgttcatagccgcctggaatttgcgggcataacccgcggataacggtactggtcagggaagcaacgcagcgcagacacgacccgatataaaagactgcaaacgaggttttgtaggggtaatgagatgatgtggaaaagaaatgggtcagggggcgctgtttgttgtgacacatttgcgcctagtgtgggaccggggcgtgcggcgagcacccagcgcggaacgactcgcaagctgacggtgcagggctaactcgcattagaggaagtgtttgctgatttcttcgtagacgctctgcgccgagagcgtctcctcgtttaacctttatgaagaaggaagtcgctcccatctggtgcggaacgatggggtacttctctccgtaatggggaaccgaaaactgaaccaaatacagaaattagaagaggaacatcggcttttcccgttatgtaaaaggaccatggggtcgcgtccgggaggagggggagagtttggggaactcggggccctaagagcgctacaccagactcttcataataccatatgtcaaggcagttgcggtaaatatagcgacgaccgcaaccgaacgggtatttcttctacaggttagaaccatcccatgacccatgcgaaaagtgttacggcacagagaaggccagagggaaactccgcgtccggcaaagcgcacggtaagacactcgcgaggttgtgcaacagcgcatcgccccgggtagaaccgacaggtttatcttcagatggctatcgcggacaactcgtcgtcggggctgggggaggggggggtatgtgtcagccacttccatcctcgtcgctgtcgtcgctcgcaaatgtgggctatcaacgcttctcgattaaaaaaagacaaactagaggggcatccgcaataaacgacaatgtttcatcacaaaacaaatggcgtggtctattctttttcgtttgcctctgatcctgggcggtccgtactgcggggtgatagataaaagaagacaacagcagggaatcgaggtggcgagctcacaaattgcgaagctcagcctatgccggcgatgatggccgatgagggaatgtaggaagagagggcgtatccccgattgacgatggtgcgaccaccaaccgagtccgtgtactcctatcttccattctcacgacaccggacatgagaaacgatgcgcggagcaagtcgggggggggggggggaatgaatccacggcacgcgcagcgcttcctttacattgcaccacgtgaccatattcccataatgacggcaggcgttatctatataatgccaggcagaagtcttacttccgctcgcgatcactattgtcgtcacacggggagtctgactaggcggtatggacggcgtacgagacagagtattacctgatacgtcaacggacaacgagatctaccttgggtcggggtatccggtgcaattacatgatgaatatgggcaaatttctctaggctcgccggtcgaaagcagcaatagcacaggaaatttttgtgctccgccatggatgccggatatccctcgtttaagtaatgatacatgtaagatatttcggtgtctgactagctgtcgtctcaattgcgcaccgttccacgatgctctcagaagagccttgctcgatatgcacatgttaggtcgaatgggattccgtctacgacagcacgaatgggaacgtatcatgcagttgactccagatgagagcattaacctgcggagaactctcctggaagccgacgagcggagcagtcattgtatgccgaacgtgtacgcatctgacattagtaattccctcgaagctggtacaatgcaagttacctccagctccaatatccggggtatcagcaacaagtccgtaaatcactgattacaaaactcactgatgtagacgaacaataaatgtcctattgccagtaatcactttgcctgttatttattgaatgagtatgtcgcgttaattaagtaacgcagtgtgggcgtgacttgtaccatatagatttctattgactacaacgttatccgacctgacatttgggagctgggtgtctatagagacagaaggtgcaccaccgcgcaagataatattgtgatatgtccagtgaggtatgtgaagtaccatcaccgcaaaagcaaatgggcctgtggtcggtgtgccgcaaacttcgcagaacatctcatctgtggccggatcctgcgaatgagaaagtatacggtatactttctgctggtggagtacatatatcatccctgccaaagtctgtacgcggtttggcccgaactgtattgaccgctgccatggtctctttcgcggcaatgaaagctggtatgccgccatccattcacctgtggcgtgagataatggatttaactgacgcaacaatccgccgcgaacaacggtccacatcaaatttctacgtagccggttcgttgaggaaaatagtaagtgttgcattgcgaaattataagcatgcacctgaaacgcatggagaaatggatagccgtctgactgctattatgtattggtgttgtcttgggcatcctggctgctgtattgtttcccatttatatgaggaaaacagtgatctgattaagttgttgggaatggcaacaggctgtggagaaagcccgcttactgaagtagagtcttattggaagcctttatgccgggctgtagcagcgaaggggaatgcattaatttacgacgacgtcgaagtggcacattacctgatcaacgtgcgacaatcgtctgaatcttcgcctccagacgatggggaagacattgagtaaatttgcgcgaatgacagggctcggaaacaatgtatagagttttgcaaataaacactttattgacttaccagaagttattgcatcttattgtaatctgcgtcaatattctctaacttcagttaaaacgtagcaatcgcagaggggcaaactagagaaaaatggacccgcgacctaaatctcgtctaaaacgctccagtgctttacagttcgataatctggacctggggacgcgtataggatcgttcctccacatgcgctgctgtcggtatctcgaatccccggtattcagttgaatcgttggcggagtgtcctcctggactctgcaatgttccctagccgtcttcactatctcgtgcaaggctctataatacagttcctctgcagacccgtcgttgctcttcccttctgcgtcgttagttatttctgtaggctccagacgatttgcctgcatttgtgcgcaacataatctgattgcattccctatctcgtcttccggtaatcccataggtgttcggtattcgcagataggtagagaaagcaccactgcaaatcgtgcaatttccattgccccaaccaatattttttttaagaacggcatcgccgttaatgtacctcgggcattgtgacgatcgaaacccttatggatgcctaaagagagcattgcggtccagttctccaggtgaaaagagaatagcgcgggtagaaacgggccgattagttttatcttcgccgcgtccctaatatcccaagttctgcagtataacttccatcgtccgttttcgacaaggtccggcgcgacatagtttgaaatgtcatctatcagaaacatctcgcccatcgtagaaaaaaacctgtacgcagaccataaaaccattcggtaccacatatccttgtgtatatcaaacgatatgttggttatgtcgttggcggatgttgtatgaaatagagctaagcgttctctggattccacgcactgaacgattccgttagtcaattcatctgctaacataggccaaaagtttattcgtgttacttttctcggcggtttggcaaaacgcccccttggcacatccatgtcattaaatacagcggcataactcctactcatgtgttccatagcccaggtttctgttcggtctgctactacgatcagatcagtggcgcgatcagatgcgtgggatgaatgaagtgtatccgaaagcagttttgagatatacgctaaactgtacgacgattgtggcactaaacgaagctttgcgcgacccccatcccacgcggagtctgtgcaaggttaatgaccctcgcagttcattcggaagttataactgccgccttcgcacatttctttttgtcctgttttgtattgccataacagataggaattgaaacctgatcctcctgttttttgcagcatggccagcaacagaatactttgtcggatcgactacttgcgcgagatggttccgttcttggaggtttcggcgggtcgggtggagaacctattattttatacacacacgtcataccgttgtcgcgaaaatgttctttgtcttctgccgtctcgaacgtcggttcccacgtagacgttaggagcgttggaatggtatcaggaagagcccacggcatgccggaccaagtacccgctactttgaccgcgagcagtctcttcggtaatgggatgtattccagagcagcgcggcagagatcagcggcccccactatccacagactgtatgaagtgttttctgaaacatcggactccaacatcaaatatccagacataacatcttgccattcggaagcacatccgccgacatcttcaaatagcctaactataaacgagtctctagttcctgctaacccagtacctcgaatgccagtcccatccggtgggttcgtcctgataatcggtctctgacgccgaggaagaactaaaaggggtctggaaaagcggaacagatctgcagaccgaacgactacagacacgcccacatcatcatgtatctgttccatgcattgctttatgagaaaaatccataaggccgaggcggcatctctagatctcccggggagtctctcgcactcatctaggagagtgacgacagttatcatagacacgcccatttgtgcaccaaacgaaaagttcctgtactggtggagcgtcggcgcgggaatcggtccgtgctctgaaaccagtgtctagacagaagaccatccggtaaattctggtgtatgaactgacggtctccagacgaacgtcgaagacattaacgatggaaactaacgagctttcttcaaaagtgtctgattacaacgctaatagaccttacgaaactatacgcagcgataccagtgacacagatccgtcggtgtcgtgtgggactctctccgacaaagacggggacgacgaagaatctatagatttaagcaaggtcccgaatgcaacgaatgtcggcgcaggtgaagattgcacatcccccaacgacgggcgcacagagttatgccgtacgacttcggttaccggaccggcctcggtcgtgaggatgcaatacaatattatttcaccattaccgcccagctcggagggccgcgtattcgtctgtacccgttgggacgatgtcagcaataagaaggtgattgttaaagtcgtcaccggaggtagagacccagggagagaaatcgagatcgtaaagacactttcccattgcgcgattatacagctaattcatgcatatagttggaaatctacggtatgtatggtaatgcctaagtataaatgcgatctgtttacctatgtggatagaaaggaatcaatacctttgaaagacgttattgtcattgaacgacgtttgttggaagctctggtttatctgcacggcaaaggtgtaattcatcgcgatgtaaagacagaaaacatatttctggactaccccggaaacgctgttttgggagatttcggggcagcgtgcaaattagacatgcatgataatagtcccaagtgctatggttgggccggaactatggaaacaaattccccagagctcctcgcgctagatccttattgtgccaaaacagatatctggagtgccgggcttgtgttattcgagatgtctgccaaaaaaaggacactgtttggaaaacaagtaaaaacctccagttctcaactgagagcattgattagatgtttgcagatccacgctttagaatttccacaggatgaatccacgactctatgcaaacaattcaaacaatatgcaatcccactgcggcctcctttctccattccagaagttgtaagaagaaatatcccgtcaatggatgttgagtatacaattgcaaaaatgctcacatttgatcaagagtttagaccttcggctcaagacatcctggcgttccccctctttgtgaaagaagccccccaaaatctccaggccctatttgttccctgagtgctaacagcacatgcaatcgaatcccattagaagccgtgctatttaaattttaatgtcgcatagaaatatatggtatacggcgccacgcagagctctatacggcttccactttagaagccaatgttttgtcatcagtgagtaatacgacttgggttacaagagacaaacataatacgtcgaacttaacaaatgccggaatctgtacccgttttctcatcgccgctgctgcatattaacggcaggaagcccttaggtatagcctgagcgtttttacgtccactgcattgccatattcgctacatcacgtatttctacaagaagatgagagtgtctattcaacgggcaattttcctgatatacatatgtacagtctccatgtccagctcggaaaaaactcgtaatgaggacgcctctcgtattagttcttcggacacctttcgcctaaaagaattccccgtatctgcgataccatcgcctctactcgacgtagtcgataactcgtacccgacgaaacacgtcatatacactgacacttgcggtttcgctgttttgaatcccaccggcgatccgaaatacacaatcctcagcttacttttgatgggacgacatagatacgatgctactgttgcatggtacgtcctgggtaagacatgtgctagaccaatttatctacgcgtattttcagattgtcatacaaatgaacaatttgggatgtgcacttcaaaatctccgggatggtgggatattggttatgcaaaaactgcgtatattgaccgtgatgagttgacgttagtattagctgctcctgctccagagttgggtgggctatacacacgtttaatcataattaatggcgagccaatatctagtgacatacttctaacgattgaggggacgtgtagtttttcgctcaaaggcccaatcgacgaccggctctgtaaaccattcaacttttttgtaaatgggaccacgcttgacataggcatgtttcctgcacgaactccccgaccccatgaagaaaacgtaaaacagtggcttacgcgccaaagcggaaaactggatacggttattggtgaagcgtccatgcgtcatgcagcagatttgccacgtgcttttagagattcgtatttgaaatcgcctaaagataacctacctgacgaccctggaaggcctacagtttcaattagcagtatccatgccaatgatgcctatgtaggaagcacctctctgtatgaccaatcgctacgcgcaactgaagagccagtattgccatctgtagatgaggcccgtcctgcgctttatacaaatgcagagaggaaccccaggatgcaactaataatttctgccattgttgttgctagtactgtaatggtcgcactgattgggataagtgcatgtattgttaggaaatgctgtaaaaggaaaatcaaaagagggatacctcaacgcccgtccaggaaagtgtattcccgcctatgattacgtatggacttgggcgtgtcgacacagacacaaaacccagtttgcggccttcttgaaactatcgatgtaatgtctctgtcgaacgggcacatggcacattggagtgcggcgtccaaaaaacatatactatgtttcctatttcttgtcacggggagccattctctaatcttcaccgggacttcgttatccgcatcgacggatcaatcggccatcgttgccttctgtggactcgacaaaacggtgaatgtttacggtagacttttcttcttgggtgactcggttggtgttatttcttacgatggaacgacagaaattctgagatggaacgaaaaactaaagtgtttctcggtcatgtatgccgcgttgtatacggactgcccccttgcagggtctgctttatttagaggatgtagaagcgcggtggtgtatgctacccctcatgacagggtgaagccggtttccgaaaaaggattactgctgtgcatttcagatcccagaatttctgacaccggtacatattacatccgcgtgtccctcgccggcagaaatgtcagtgatattttcagaattgacgtcgttgtgacgagtagcagtattcatacatgcggccatgcggataaaggtatacaggaatgtattaggtatgccgaccgtgtgtcattcgagaactatctaattggacacgtgggacaattgctgcctgtcgactcagagctacacgccgtgtataatgtcactcccagatcggtcgttgggacaaatactgataccatgtcagcttttactaattcgacaacaaaatctgcttcgacgaatttaatcgctatgaagactactcatccaccaagtacgcggcgctgtaacttgaggcgtgcccttccaaaattaatatacatgtcttcattggcaggcctgtgccttctcgtactattaattggtagagcggttgtaaagtgcaaaacgcccaaacccaaaatctacaagggcgactccacctctgacggcatctcgcttatcaattctgcagtaaacgacgcatttgggtgtaatcctgcaaaagaggttgatccctcgaatatttctgaaggcgagaagctggaaaacatgcagaaaacgaccggaaatgtagaaaagtaaccgtgcgagttatgagctggaatggacgttacatgcgggaagaagtagggcgtaactaagtacatgttagaaggggaggggcgggttttgacttttaaaagcacaccgcgggaccacggcggaattatgcttgatatacccgggctacgtggcataatgtcttgtccgcgaatgccccttttcctaatggcggcgatgatgtgcagtgcaaccaccgtaaatcgtatactaattccccaggggaattcggcaacacttaagatctccagatatccgccggttgtagatgggactccatatacagagacgtggacatggatctctaatcgctgcaacgaaacggcgactggatacgtatgtttggacagcgttaattgttttcatgacttaatcgttaaaatggcctgttggcggtattccaaagaggtaatactgcgcactgccagattcgtggtagagaggggcgtgttaaaaacgatagagaccgctaagctgcgcaacgctccgcgtgtattgattgtggacaacgtggacactcaatggactgttttgaatgcgagcgagcaaaacgcgggcatttatattcgatattcccgaaatggaacgagaaccgctcacgtagatgccatagtccttgccgtttctggtcgaaagagaggcagggtgccaccgacagtttatcctgttggaccatttttgcacaaattccaaatctcccttaaaaattttaaaacgttcttatatcaggtgggggataccgttacaatatcgataactacacgcctggagacgacggttcgtgcgttcaagttggagtttcgggtaatgtttctcccctacagtccaaactgtaagtcgttcactatttacgagccgtgtattttccaccccaaagagccagagtgcatatctccgtcggagctatcggaatgtcggtttgcatcaaacgcgcaggtcctggaaattgccgccgcacgctcggtgaactgcagcgcgggccgcgcgtgccattacgatgccgaggtcgacgaatcgatgcagcaaaggttcgcattcctttattcggaaatcccctcgtttacaattggcaatgccgggccgggggacgcgggtctgtacgtcgtcgtcgctctgtgcgatgagcggccgacaacttggactcacgtctatctatcgaccttggacaagatcctagatgtgcacgagatcgctcacaagccgggatttgatgacagagtcttatcgagcaatgacgacgccgctcgcggtgtaagacccggagcggccatcgagaaagaatcaggtaggctccgtctaagcggagccctaattgcatcgatcgtgctggtggccgcggccgtcgtaactacggtaagcttttgcggagcttgcgtcttccggtggcgtcgcaggtgccaccggaagacgcaagctcccggcaactcttgcaagtacatgtcgttgccccaaaatcattgggaagagttttacgacgacgttagggttggcagcgcccctcagtatgagcagtttaaccaaaggttgcccgagagaacgagatcaggctacaccgcttggctctcgtctgatatagccgccgtaagaaagcgtctcgattgaaatcgccgagacgtgcgtgccgattgttgtttttattgtatcgcccgtacttaacggtcctttatccccgcgcgaaataaaactgtccgactcagtctactggtgctcgcgtttacctccactgcgtaccgcgcgccaattttcgtgtaggtgtgcgtatggtggagtggtttgggggaccctgtctctaagccggcacactccacgctatttccccccgcccggtgggcacaagcgcttgcgggaggaaccagttgtcggttttttatgcgggctcctcagcaccttcgccacccacccacactccgcgccccgactgcgcgaagctgccccgtttaggcaaacggggcccggccggcgcgacgcagaagaataaagcagactccgtcgtttcttctataatggagggtatactcgtttattgcgacatcacaccccgtgttgctattttaaattgaaggccgttgataacccgcatcatccactaacgtcgttagcgataacgattgtatcttcccccccccccccacctacggtttgtcgacagctatgataagcggaggaaaacctgcctgattccttgggcggggatccttgtgcgctgtcttgctctgtatgcgccgacccaaagccgcctcctcctcaacgtaaatttaaccgcccaggccgcgtagttgcgtgtcctgaacgggaaagaagttcgttcgctgttattgtggtcattaccgtaactgtcccggcgtgcctccatctgctgagtcccgtgcagactggcatgaggatggttgttcggcggcaggcaactcccccctcatccctactaatcccgaatgcctttaatgatcacgcaataacccctcctcttaacaatatctctttttcgatgaagatttcagttcccccataacacggcagaacgagtctgatccctgatcaattggaacgacttccttcttcagaaaggttaaacgaggacacagtctgcgacgagagggcttaacacttcctcctgtgcgagagcgcgtctctgcgatgtggcttcgccgcaaagtcctttcccatactaggcgtaaaccgcactataacaactccccctccccccagcacccaaggggcccgtgaaaccgcgactggtttcttcttcactggctcagtactgcaaatgtgctgcttacctcgtgattgctgtcgtcggggctcgttcgcactttccaggccaccaaagaaagcgagaccagagccaatcgggaccatctccgaaccttgttcgctaccacacacgtgccgccctttgttgacgtggccgcaaacagagctcgtggccacgccaacgaactgctcgtcctataaaacccctcccatactcaatgccccctgaaatgtttgcaggggggaaagtgaagccttctgcttcattcaggtgttcgcaatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacaggaaagggagacgtgaccgcggccgtctctcccggctagctccgagccgaatcgagaaggggctgccgccggcaccgcgctcctggtaggtgctgtcgggtcgcgcgatcgcgtggacgccggtgcgttaggggcaagtagggccggccccccctcccccacgcagcgcctattgccccgtcgcctctctttgtccctgaccccgacgcgaatatcggggggggggggggcggcgcgggtcggggaaagaggtgggacgtgttggcgtgagcgttgggtgcttaataattcgctctgtccggccgtcggtatttctctcccaccaccaccccctccatttctctcctcttctgtctccaaccaccaccgccccctccgtttctctcctcttctgtctccaaccaccaccaccccctccgtttctctcctcttctgtctccaaccaccaccaccccctccgtttctctcctcttctgtctccaaccaccaccaccacccccccccccccccccaaaaaaaagaaatacacgcgcgcgcttgactttttagagccgggcggttcgcccgagcctaagcgtctcgatgctcaagggccggtccgcttcgggttctagcccccgggcgagcactctcccgagggcggtaggaacgtcgggagcgagagaaacaaaccgcacgaaccgcacagtcgctcgcaggagcgtgtcgagggttaatgtctccttacctcggcgtcgctaggagaatgtttgcccccggggagcctagcagcgctgaccgcagcatatctaatggcaaaacctgctcgtttcgcaatccggccgataagcgtttgtttgacaagaaacgttgtgggcggcggaatgtttacctatggggctcggctgattcggagagcagcccggggatcaaatcgcgttgatgggagttaatgattaaaggagtagccaggccggcactgccggagccgtggctgtggtgtgtgtaggggcggggtggtggtggtgttgggcggggggcaagaagcgatgcgaactgcggggaacgctttctcacggttccccctcatttttttcagagcaggactccttccgcgctccctgcgctggtccccatccgcccgattaacccctgcatttacgcccctgtaaggagcggatcgccagtgctgccggcgtcgccacggttggaccggcgcgcgtttcccccattgctcggacatggagaacccgcccgatttctacagcctgttagagatgttagccgacaacggcggattttctccgcagccacccgccaccccgggagatccgtaccaggacgtgtgcttgaatacaccgagcgtggccgtgcccccgacgcccggtcggcagcccgtcccgccacggtctaaatcccctgcccgcgcggctcccgtcgcgggcagccttgccggcgcacgagcccctttcggcattgagggtgccgtttcggagggttcggatacgggtctccgttccgccgaaccccccgacggcgcgcatcaggggtctcctggcgaggtcgtcagttccaccgcggacatcgtggacgtctgtggaaacgaaacggccgcggcggccccgcggtcctgttcttggcaaaagacagtcggcgatctagtccccgcgggttcggaacggggcgaaccgagccctatggatccccgcaaatcaaacgaccccgtccgctgcgtatctgacgcgccctgtaagcccaccggcgcctgcacgccgctcgccgtctgtgtcgaaactctcccccctccctcgggcgtgccccccccacccccccccgaacctatcgtgaacttcccatggacattttctccgctgacgccgggaccgttcgctcaacaccattcacccactccccctacaccacctccccttagcccccctcctcctacgccacccccccttagcccccctcctcctacgccacctccccttagcccccctcctcctacgccacctccgcataccccccctccgcacggttcccctccccccacgcctctgccgtctacctcccctccctctacgcagacatcctccccgtctgcgtctctaccgcttgactcgcctccggcgtctaccccacctccgccaacccctctccacgacaggcctctttccccggaccccccagccctctctgcttcttgtcagcgtccttcccctccgttgtccccttcagccccccgcctcgcacccgctcccctccggagcgaccgagtcccagcccgccgtaaatcgagcgtttccgagggcgggggcccccgtaccaggggcgcgggcttccagtacgtctgccgcctatccgcatccgccaggatcccatccccccctcgagaagagctcgagttggtggcccgccagccggggagccacgctatgttgtggcgcgcgggggctcgcgacggcgcgacggagccgtcctccggagacaaccctaaggtttttctcctcgcgttgtcggacgctcgccggtgcccttcctactgggatcggctggcgagggaagcggtactcagagaaatcttacctactccgcgcggcagccctctgcggacctcaccggggtctatcgaactgccgagagaggcccctttactcgacagcgactaccggccgttcgaatggcgttgcgcgaagggtcgcccgctgccccaggagccggtcttcccgtgccctccgaacgagctggggaatgactgggcggcctgcaagatgtggttgttttctcgatgcgcgcgcctcgttctctcgaccctggacgatatgtcgccgtccgaggacggggaaagcgtgttagaatcgcagggttgcggatggggcccgcagaacgagtgcccgctccccctccccgccccgatagtgctgccaacgcgcatctgggaagcggtaacacggctcccgagaccggctccgcgcaccccgacgtacgcttacattttgtcggcgctccttcgcttcctcggccttcaagtcacccccgatttcgtgtcgaaggttccccgcctttcataccgctggctggaccgactccgctgcgtcaggcgcgtccagtacatggcccacgttctgacacgcgacttttcctatcaattacaagcggctcgtggtctgccgtgctttccggcgtgcgcgccgccgccgggcgcgggtactcccttggacgaggactggaacggaacgccgccctctgaatccccccgcggtctcgactgcagccggcgccgcggcggcttctatgcctccaacttctgtcctctgctcgaggagattcggtgggtggaaggccgggaaggcagcccgaacccctggaccgggctcacctggaacgatttcaagatgctacattacaggtgtctttttttcaaagtgcgtcgggggttactgctggccccagacgactacatcgtcggccccgacgtgcggcccggcttcgaggtgcctttcgaaatgccccccccgcccgccaccgcgctccctcccgcgctttccgcggccgtcagggaatcgaagttggcgctgcggaacggaaatccggaacccggcgggacgccccacggctctcgtcccgcacgcgcctacggattcatggtgcagcagctcgccgtcgctatggtcgaactggggttccccgcctgcggtccggccatcgaaaaacgggtcagacctctgtacaaagccatacttgattggcgcgccgccgtcaccgccgcggcgctacgccgattcagacacctccgtcagccgtccggcgcgagggacgacggagcgcccatgtttcccccccttcccgttccagactggaacgggccgtctccgaggccgggcctcgttagcagccccaccggtacgcaggaacgttaccgcagagtccagccgggatcgggctccgatggttcgcacacaacagctccacctgctgttctaaaacaggcattacaacaggaggttggcacgccggcgacccgcgcttcccatcccctaccccggcctcccccggcctcgtacccttcgctcgggtgtcgctccagatcttcctcctcctcgtccgcttcctcttcctcgtcctcttcgtcgtccgcgccctcttcatcggaacagtcgtctgccgccccttcttcgcgcacctcatccaggtcgccgacccgcgaggcaggagcgcctcaatgcgctgccagaggccgcggccgcggccgcggaggacggcgcggccgcggccggcgggcgccatcaccgtcctcggaaactgctgcgccgccaccgccggatgacctcgaccaagaggtgtggtggcaaattccctccccgccggccggccggtgctggttcgggcctctcggcggacaccgacaggcgctccggggcatccctgaagtagagcaggccgccgttagattcctctctactcccggtcccctcccggtgtacgtggaggaaatggggaactgcgccaaacagtacgaggcgctcgtaagcgccatgcttaacaaagacgtgaaggcgaaccccctgaactgggcacaccacggcaagctctcgcccaccgacgcagcgctcaatcacatctatgtcacgaagtttcagagctcgcacagttcgccgggcgcggccgtcacggggacggtcaacaaatgcataccccacatagccagcgccatgaagaagcgaaatctgctttgggcgctaccgcacatcgccgccagcgtgtctatgactcgcaggtactgcaaagatcagaaagagttcatgttccgctccctcaggaaagcctacgcgcctatggcgtctgcagccagcgccgaaatgcgacgcccctcggcatcgcctatttcaaatcgggcacccgtcactgcccaaagtacggcggccgggctcatcccggtaatagacgtgtccacgatccacgaccgcgtgcgccggggcgtcgcggccttcaattccgcgctagaggagggcctgctggacgtccccgaataccgattggtcgcgcccgcgcgtccggacatccctgccggggacggtttcgcgtctacccggccgctgaacgagctggtggacgcttgcgcgctggagtgcgagggggtcgtggcggcgcttctgcgcggacccgacggtccgggcgcggtcgcggaaatgctgtcgtcttgcgaggacgggcccttccctcgacccgccggccacgaacagtgggaaaaatgccgggctctgctcgggtcgtggctccgagacctgcttgatctcaggagcgccgtgtacgcggcctacgcgaacggttcggctcctcgggggcgccaggagcgaactctcgcggctaatgcggtggccctgataacggaagcgatcggcccgttgcttagcaaagaccccgctcggccttggcgatgccctgggtcgagggacattacttccgtgctcctgcgcgaatgtgggtcgaggggcgaaccggtacgatcccgcgagaaggcccgacggctgcaacgcgtggcgcgccttctcgcggacgccgacgcggcctcttccggaacgtccgagggccggtcgcgctccgcggagccttgttacgaccccggccccgcaagttctcccgagcccgtgcgggccctttgcgcccaaacgtcagccgagtcaaggaagagaaaatcagctcccgcggcggttctcgacggcgcggacaacgccgtcgagaacccgcgtccgcgtttgggaaggtcccggacaggcgccggacctccgcctgtcgccagctgcacaaggccccccaccccccctgaagcgtgccgcgacgccgggcctttcccgcccaagcgcccacgttgctttccgtggcgcgaccccgcgcgcattatggacggttccctgtcgttaggcgatcgacggcatcgtggcgccgcctttaggaagccccccattggaactccgattgctggctatgccggccccccgcacctcgacgcctattgtccaggcgaaggagtcgacgagctgaccagcttcgcccaaataccgactctgtggcgtcagccgttggcgcgttctccggaggccatggcggagatcgctcgcgtggcgagcactccctcgcacgtcagcagaagcccagacactgctgcgtccgagggagtgttgtgccgcacggccgtcgtctctctcagagcgcgcaccgcttggatgcggcatcagcaggcttcgcctgaagatgtcgctctcgtcatcctgtacacggccaacccaggcgagcacctgttttgcgtaccggcgcccggctcgccccccgggggaccccggttcgacccgaaccggggaggactctctttcctgctcgccgcactcgccaaccgcctctgcctaccggagagcgccgcctgggcgggccggtggagagcggcgccggacgtttcggcgctgaccgcggccggcgtcatgttcctgtcccctcaggacctcggttttgcgggcgtcctggaacacctgcaacgcctctgtttgaaacgagaaaaaaggctcgtggtcctggacacgctagaggatcaagatcgcccggagaacggcccgcgcctcgtggaagaagccgtccgctacgtcaggtgcaccgtctcgccccgcagccaatgctccgtccgatggcctggccaccccgatctagctacgacggtcataacctcgcgggacgtgctgggccccgtggtcctacgtgagctggaaacgcactttcgccgcgaaaaccccgcggccggcgacatcagtctgtgctgcggaagcaacgtccgatacaaggtcgcgacgcgactggaccgcgtcgcgacggtcccaatgaccgctctctcctacctcgcagcctcctcggcccttgtggccgggcgccagaggccgcccggccccgactttttagctggagagtcgcactcccaccgagccgctctcaagtggggactgtacgccccgctgcgtcccgtgtacgtcttggagcccaaaaagaacgccatagtttcccccgatttcttaaataggaccgtctgcgacgtttgccgctccgtagtcctcccccccgatccgcacgcccagccagtcgtcgttcacgttcccgaagcgacgtgcagtttattggcccgcgagatgctcgctcacctacgtagctcgtctgtagtgtggctggaaggggacggcggtccgccggagaccaccgtccaggaggaacagggcgcgcgacagaggataattcatcctccgacgctgcccggtcctccttcgcccttggccctcagcgactctgaagtcttcggcgagtgaaggctaagtcagggtcgggggggggggggcggggggagtcactcggcggacttttaagggctatctggacaagcagccccgcgggtacgacatatcatccgcgagcggggagacggacaaataaattagggggccagcggaaccccgcggctcggttgcgttccgcgctgttagtcgtacgggccgcggtctgccgtgcggatgcgtcaccgcctggtccattggtcggccgtggccacgcctctatacctgttcccagaacgaatgccccgcgcgcaccttcgcccggccattcagtagcgcagaagcgccggcgagcccgcgggcgcgttcgccgtagtgttctcccgcaaacgcggtagagaaagtttcgtaaaaggaagaccgcgcggcgacagcgcctagaagacccgtggcctgtacgaggaggagcggcggcgaaagcggggtcctttcgccctgcgctccgccaaaggggggaggggacggacaatggagcctcccacggcaaagtcggacggggccgcaccggatcccgacggcgacgtgaaccgaaccgacccgccgctcattgtccctcaagcctcagaactccgccctaccttctccgaaagctcccgggggtccccgacggcggtctgcccgggaaccgaaaccgcgggcgcggagccgtggccccctggactcagatcgccgcgtcctttccgaaggcctgcgcggctgtaccgaagaatcgcgatccctagggctgcggaaaccgctcctccggatcctgcaacgagctccgctccgtgaaggtcatctcgaacggatagaaccgctcaaggtcgggggggggggggggggtggtggtagggttaacggtagctgggattgagatgtagcgctggcgaataaataaataaataaatgaatgaatgaatgaatgaatgaatgaatgaatgaatgaagggaccagatgcgacagacatcattcgcgctctctgaccgactcttgccggcggcggcagggggtttcggtcgccctgggtggccgggggggggggggcggggggtgcgtccggaggcagcggcgcgcggggacacctctgttcttacgctgttcgcggagagccctctaccccgcggatcgatccctcgcgcgggagcaatctctgcggtcccctgcgcagcccgcggagcggttcggtccgcggcgcgctcgcccgctcgcccgcccggctatcctcttccgcagcggcaccagaaagtggcgggaacgagcgcgcatacgggagacataaaaatggcgggggagacgggtttctgatcgagtcggcgagcgggcccgaggaaagcggcagcgggacagggtttccggatcggaccgcggcggctaccgaggcccgctgtcgcactccgcggtccctaattgttcgcccgcgcacccccctcccccaccccattcgcgtcggcgagcgggcccgaagaaagcgcaggggggacacggtttccggatcggaccgcggcggctaccgagtccacctcgcgccccccgcggaccccaatcgttcgcccgtgacggtctctggactgttctgcccctccccctttcccccaccacccacgccgcagacctttttcgagacgaaccgcggctgtcctaagtgaccgagacgggcgcctgaaaaagccttgcgtctgatcggggggggggggggggcgcgactccaagcgttagaccgccgaccgccggcggctccgcgcggccagtaggccgagccgcacgctgcatccccgccggacatgcccgccggccgcgcgggcgctcgctaggccgcccggaaatgcgtagcggacccgtgcgcgcatgcgcgcagtcgacatttgcgagcatgcgcgcggcggaccctagcgagcatgcgcgcggcggaccgtagggagcatgcgcgcggcggaccgtagggagcatgcgcgcggcggaccctggccaccaccaaacgtcataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggct

SEQ ID NO: 6 - DNA, 20 bp, unidentified
  source 1..20: mol_type = other DNA; note = cebador o forward primer 1F
cgttgtaaaacgacggccag

SEQ ID NO: 7 - DNA, 20 bp, unidentified
  source 1..20: mol_type = other DNA; note = cebador o reverse primer 1R
tggcttgggaacaataccct

SEQ ID NO: 8 - DNA, 21 bp, unidentified
  source 1..21: mol_type = other DNA; note = cebador o forward primer 2F
attgagtcaccacccctatgc

SEQ ID NO: 9 - DNA, 20 bp, unidentified
  source 1..20: mol_type = other DNA; note = cebador o reverse primer 2R
cccaacttctcggggactgt

SEQ ID NO: 10 - DNA, 20 bp, unidentified
  source 1..20: mol_type = other DNA; note = cebador o forward primer MDV2-UL45-UL46
gcaacgctaccgagctagaa

SEQ ID NO: 11 - DNA, 20 bp, unidentified
  source 1..20: mol_type = other DNA; note = cebador o reverse primer MDV2-UL45-UL46 R2
aaccctccctgccacttttt

SEQ ID NO: 12 - DNA, 20 bp, unidentified
  source 1..20: mol_type = other DNA; note = cebador o forward primer SB1_FXII_UL46F
agtcatcgtgacaggcaacc

SEQ ID NO: 13 - DNA, 20 bp, unidentified
  source 1..20: mol_type = other DNA; note = cebador o reverse primer SB1_FXII_UL46R
ctacgacgggattggcgatt

SEQ ID NO: 14 - DNA, 24 bp, unidentified
  source 1..24: mol_type = other DNA; note = oligo cadena superior gRNA1_UL45/46/SB1_T
caccggcgcgttcaaaaaaaacac

SEQ ID NO: 15 - DNA, 24 bp, unidentified
  source 1..24: mol_type = other DNA; note = oligo cadena inferior gRNA1_UL45/46/SB1_B
aaacgtgttttttttgaacgcgcc

SEQ ID NO: 16 - DNA, 20 bp, unidentified
  source 1..20: mol_type = other DNA; note = cebador o forward primer SB1_UL45-F
tatgcggttgtacgatcggg

SEQ ID NO: 17 - DNA, 20 bp, unidentified
  source 1..20: mol_type = other DNA; note = cebador o reverse primer SB1_ILTV_UL45-R
agaaacgttccggaagggac

SEQ ID NO: 18 - DNA, 20 bp, unidentified
  source 1..20: mol_type = other DNA; note = cebador o forward primer SB1_EGFP_UL46-F
ccactcccactgtcctttcc

SEQ ID NO: 19 - DNA, 20 bp, unidentified
  source 1..20: mol_type = other DNA; note = cebador o reverse primer SB1_ILTV_UL46-R
gttgtgcttctacgacggga

SEQ ID NO: 20 - DNA, 3570 bp, unidentified
  source 1..3570: mol_type = other DNA; note = Genes D e I de ILTV de la cepa VFAR-043
gaagctttcgccgcgctttagtaaaattaccaggtttgcagacaggggtcccgcgggcgggcagtctttctttcctccgtcgtaaattaaatcatgaaagcaatagttaggcgaagagcagacatcggccgccttcatcttgcacgcgttccgcaggacttttgtccatttgattacagtcccttccggaacgtttctgggatcatcttccccgaggacagcctgagtgccttccaaaaagaggacgtgtcgcgtcgcaaaagttaggcgcgcaagacaagaggcgagaactatcactaacatgttcatcctgcaatatgctcccaagcctactcaacaggggctctccccggctgaattctcctcctaagtgttcagaggcctctgctgtaccatataactatcgtgtacgcccctcccagtccgtgtccgatactgccccttttgagaggattgggagattagagaatcgaaatgattggagagccacattcagacttaatcacatttttattgagtcgggcgagcttagcgcagacgggttaacaatcgcaaccagttccacaagttcactatcctggtcagcccccttgtttatttcgcacgcaaccatgggtccaaattttcgcgattcccttctagtttgggaacgttcttcgtcgtcttgcgagaccgtgtctaattttcggtgcggggtgcacatgtttctggtgacgatggaaattacaatgacgaggccgatcgttgcgctcacgacggcagccacggttaccccaattagcgtagggctcattgtcccgagacggacagtaacgtttgaattttcgtttgcgggtgtcggttcgtaatgatccacgccattttctagccagggaaaggtaaagtgttccgcttcaagttcggaggcgctggttgcagtgacgggcgtcggggttgtcgcctcggcgctggtcgtcgtggcctccgtggcaacgtacgcttgccagttgcgccaactttcctcggtcctgagataggcctcaagttggacggtaggtaatccgaaggtgcgacacgaagccttggaatagagtccgcgagtcgcggcggtgttcgcgaattgatacaccgatagttggatcgcgaagacgtcaatgggttctttggtgtcgtctagccgaacaattacgtagaacatcccgctgtcgttcggacgaggatttcgtatagtgagcttaaacgggtgtggaggtccggttagtctgttcgaggcggagaacgtgtactcggtcactttacagccgacaaaaacagaagacgatcgatgagtgcaattttcaaagcgctcctcgctaagttcctggtagcactggtttgttatatcagaccgaaacgcgacgcggacggttcctgagtagggtttgtggggtctctggccaggcatgaaaaatagctgcagttgaattgtagcttcggggcgaggcgcgacgatcacgatgtgatcgtcgtcaatcctggcggagacgtgatttccagtgatcacgattcccatcgcgccgaagggtgcgagcgtcgcggcaaggagagccagagttccaagtagcgatgccatgcttttcgaacgtcccaatgaataggcattggtatgctattccatgtgatttatattatgagcgtgaggcgtggcatgtaggaagaaaccacctattctaggctcgattagctacgcgcgcattttacgatgctccaaaccagtagccccacgagcgcgaccgcgcaggctacgaacgccgcgaatatgggcatggagacggcattagaacttttagtagtctcctccaccgggatcacggcgggcatgtcattgtaatagtcaggatccgagtttggatcatcgtgctcggtgtcctcggggacttcgtcgtcttcggggagggcggcaggattttctccagaagcctctgcctgcatgtcgtcctccgagtcttctggaggggccttcttttcgctgctttctgcgtccggggtgcgcccttccgctttcttggttacagcgggaatttcttgcgggacgctatctggacgagggtctggcgcgctaggattctttttcctcagcaaattattccagcgctgcagaatatcttcgtatccccgatatacgtcgtccgcgtgtcgtgtattggtgtctgcgatcggataaaggtgttcgccttgaaatccagtctgatactgttctgttgtccagcatttcgacggtaaaaagttaagctgcgacccgatctttaaacagcgatcgttaacttctagagttacgagagctgtttgcgcaaatctcccgattttcagggtcagcaagtattggccagagagcgcagcagtgggggagaatatagtcagtcccgcgccatttcgcgatacaagggtgctaggaacatagtccactgcccacatctgtgcagattgaacggcgcattcagatagcagttgtacgtcgccacattccctgtactcttttctatagattggacagtacttgtcctcgccgtcgtcgcccttaatcacgtagaaccagacgacggaggcctcgaaagggccccccttctctttttctttggccgccgatatcatgtcgtccacgttagaaatcgggttgagctcgacaacgtcgcagcctcttgataccctagtgaggtatctgttatacgggccaaccgccggtatggttagcgcgtcgagcgcgcgacggcctaaaatgtagtcgtacgtgacggcggcggtgctctggctagcgaaggaagaaagcagtacgatagtccaaaaagcattcctcaaaaataaatggcggtccatagcgttgcgtacaaagcagatatgctcccgcataatcctgacacaagtccagaaaagagtgaatacagctgcgcctgagcagcaccgttttccaccgcaatccatgtgtttgttaagcacctctcctttcgcgtagtaacgcgagtgccgtctgagatgaggacggtgcattcgtatatattgcctccccggccagaaatccacgcctcgcctgctctcgcgctgctcttccacactgtactttggccagcggtatgcgaaacaacggtcgtggccgtcaaatattccggcagtgaaacattattaaggctccattcgaatctcggaacaacgccggacggcagagttattgtgcagtatgccgtttgcggatcagaggtaaagtataactctggcgcgatatctttttccctcgctataagagacgtgtcgaaaagacagtaaggttccggagaatggctcgtgcacgacaggcacattagctggaccgatgttcttccatcggttactctgtagtacagctgtttctgccatttctcattactgttaaaaaccccggcgggactgttcccagaaatttcatccattacatctacgaggtctactttccaattagtttctaccctatagggagatttgacggtggaaacgcaagtcgccgttacttcgccatcgtttgaaaacttcacctctacaattttgacgtccaataggggcgtctgcgactctgccgtcgac

SEQ ID NO: 21 - DNA, 172133 bp, unidentified
  source 1..172133: mol_type = other DNA; note = genoma completo del virus recombinante rSB1-GFP-ILTV (gD-I)
ataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggctgggccgcagcctcccgccgccacaggtgcactcagcccgcgggctgccgcaccccgcgaactgtcggctacaggcagaatgaacgcgcagcattgcgcggacacagtgggtgaccgaagcacaccaccacagactctgaccctgccatagccccgaccgtgaaatgaggcccggcgaggcctaacagtcaccccgaccgtgatacatgacaccaacgctgcccgttacattaaaaggtcctagccctacatgccgtaaccgccaaagccgctacccttaatatgtcctgaccccgactatggactattaccctaaccctgaaaggccataacagtgaccctaacagtcctgacgccgaccccgagaggccctaaccgccaccgtaaacggccctggcccaagcccttaatgtggccctaacaggcactaaaacgaataagacaggccctaaccccgaccgtgatgacaggccgaacccccgaccctaacagaccctatcgcggggtccaataatccgctttcccaccccgtccttcaacggaagagtgcgtgcttcagacccgcggacccgggcaacttgtacccggccccgagcgtctctgtgcaacgcactacattgaaagtaaacaacaggtaggcggtgtcgactcaggtctgtgcgaacgccaaccgctttcaagaacggaggctacgcgcagtcacgaatgaggaagtggttttgtgaggccgatcccctttcctgtttttttgagactcgcagccgattccgagaggaccgggagcgcacgacgatgggctcccgccttacagttttctccgcgaacaccgtactcctgctgggaaggtaagccgcggtccactgtttacttcccgtgcaagcacttccgcgtacgcgattgtccggcacgtccggacgcgcttaatttccgtgtcctgactgcatccggcgactacagcgccgcatccccccctcaaccccccccccgtagattccatggccgagtccgccacaccggctttttggaatttcgcggggggctggcggagaccgcctctgtcccggcgctcgggaagtgcgtacaggatgtttttctttttccggcagcggtgcagcaatggcggggacgcaggacgcttgggaaccgcggaccgcagcctttgcgtcgccgccgggagacggcggcttcatcgcgcacgcgggcgctcctagccccgacccgggctgaagccgtcggccagtacgaataaaaacgcccatggaatgctgctacgagacgcgtccgtccgtccgtccgtctggctcgcgcgcgagcgcatgcgcgcacatccgccgtttccgtaaacaccggaacgacaccctcgccggccccgaccctcaatccgcggcacgccctgaccctataaccattacacgccccgccctaattccgagagaccttaacccctaacctaaccctgttaccctacccctaacaggccctaaccctgacggggagggggaacgcctccttaacagactaacaataatggggggggggaggagggtcgctcctagccctaacgggcccaaccttcgcgcctaccctacccctgccaggccctaaccctactcgggggggggaggggggatgggaacctaagcgtggcaggtcgaaccgtgtggggggggccctgcccgtaacagaccccagcccctacccttacgggccccaacccttacaagaccctaaccttagtactcggtgggagcctaacccgaatagggcctgacattaataggccctaataacccttacacctgtgaccacgaactctgataggccataaccctgaccttgacaggtcctaaccccgggcccctaagccaaacgccgcccttgagaccctaaccccgaggccttaaccctgacccagagaacctaacactgataggccttcgcgctcttagtctctgatcataatcaccccgaccctaaagacccgatccagaagcctaaccccgaccctaaagacccgatccagaagcctaaccccgaccctgaccctaaccctgcccctaaaggcctaaccccgaccctgcacctgagcttgcccctaaaggcctaaccccgaccccgacactacccctaaaggcctaaccccgacaacgacactacccctacaggcctaaccccgacaacgacactacccctaaaggcctaaccctaaacccgacactacccctaaaggtctaaccccgaactcgacccgacccctaaacgcctaaccacgaccccgagactgcccctaaaggcctaaccctaaaccagacacaacccctaaaggcctaaccccgaacccgacccgacccctaaacgcctaactttggaccccaaccctaaccttaacggcatatccctgtccatgaccctgacacccgaccctggcactaacccttaccccgagcccctgcccctaagggcccaaccatcaccctaaaggcccgaccctgcccctaaagacctaagcatgaccttaaaggcctaaccctgaccatgaccctaagggcccgaccctaaccctaacctagtaccctccttccacaccccccccccgaaaaccgagcatagcccaacaatgaactcggccggtttaaagatttatttcgatgcgatgcgcggtcacgcccaccacaaaaatagaccctgcaatattgatgccggaaccagcccatcgcagagcgggcgaccgctacacgggacgcgtattcgtcgggaccgcctttctccggcaggtagcctacacgtacctcactatggccataaagatgcagccatagagaggtacgtgaagaagacccgtcggaatcagaagcaacatttcaggacgtacgactcgagccggacatgataccagacaccggagtccacagcgaccgcgatttcctctgcgcctaccctcggccgacgaacaacgccgagggtaggcgtcgagaaaatcgcgaccgagggtgcgccctcgttccacgcgatcccgcagaacgcttcgcgcccagtctccgtccatcgacgtggtgcttgatgacaggatccacctctaacaccacgcgatgcgctccgcagcgccttcgtcccggagtagagcgccatctccttcctccagcacggtgctcgacgcggcaatacaaaagtctcacgcctcgaacaccggacgaaggagggaactgcgcgcgtctggactttaccggggcggcttcgtcccgcggcgttccggatgacgtttcgagggcccactccatccttcggtgcggtgcccgagaagggatgacgacctctcacacacagcacaaaggacggcgctgggctccgtccgatgctctcgatctcaggcagcacggcaccgatccggagagcgcgtcgcacgtcgcgtcctacccccggagtagtgcatgacggttactccccggcaagcactcgtccgaaggaggacacgccacgcgacccgattcccagccgcttcgcgcccggctacttcttcgcctgcagtccgccggcagggctcgagcaaacaaactcccatctttccctgacggcatctaaccgttaaaatacgacgtcaggcaccgtaagggaaaaaatggaagcagttcggagtacagacgcctaaccacgggccctctctcgcccctccgcgtccgatatgcagatcggtgagagtactgatcgtctcatatccgcaacgaagacttcgggatcgatagacgttatccttcccgcccccccccccccacataggaacctctgttccatcgccatctgttacaaaaaagggcgagcctatccactggcaacgagcgagaacacagctaggcctcccaggtcgtaacaagccacttacgtcgtcgcgggggaaggtcggtccatttcgctcctattccgcaccttcgtttggaacagaagcattacacacaccgccatttccccgcgggcagaattctagtctttttgtggttatgctcccacctacccgcacagacacgtactcacctctcacgatccagcatatcgccgtaagatttacagacattcctccctccccacccaaccgaacactgcacagcggcagcctaaaagtcgctctgcggtcgcatatcccccccaccccccttcgatggtccggtgtacggagacctctcacacaacacaggacaccgtaccacggaccatccgaacggcgggcgaacagtcacgcaggacgtggacacgagtcctgcgctcgcacaggcagctgggcggcggtgctgtcttcctccgacggacagcctacaagcaagccactaggactaccgatacgaccagagtgacgtgcgtgtaagacggcccaggacgaagtcccgcgccccgccgaaaataacagcaccgacctgaaagagaccacgtcttacccaacagccgacccccgaacgatgcacgctcccaagagtcggccgtaggagagcacgcgcccccccatactcggcgcgcgtacccgcggccatccctgcagcgcggcccggcctcgttgcgattcagtgaacgtaccgcgcgccatctccgtccatcggcgtggtgctcgatcccgtcattcggtgatctcaagcaccccgcgaaggaggaagcggagcgtgtaacgatttccgcggcgcgcgacgacgccgcgccgtcccgtccgacgtttggaacgccgcctcggtccttgcgcgcagtacttgagacgatacgtgttaaaatctcaggcaccacgctaaggacggagcagagctcggttcgcttcgctcgcgcgccgacgcatctctgcttcgcagaacctgttttgaaaagaccgcagcgaccaccgcgtgctaccctcggaggggggcatgaggacggcgcccgatactcccgtgcacaccgccgaggggggacacggcgcgcgcgccgatgctcagccggttcttcgcccagagccctcccaaccttgtcccacacgacggggagcggcacggggaatcaattcgtctttctctccgcaggcattgcacaacggcaatgacacgtgcaatgccagcctgagagaaaacatacgaacagtcccgagttccgagtagtaactctcgctttcgcgcccttccccgactcgttccgagcatatcaggcgatacgaggcatttcgcgcgcgtcgccctgtccgtcccggttgtcctagaacgtgacacctctaggggacccgggaaggactggacgacgcgccgtcgtgcggtccgaccgcaatacggcgtcgttaccccttcctcacaacacctgatctcgtggcctaaatacccgctcatcgccccgcatccgacgcctctacctcccctttgtccccaaccgagaaacctatccggggcccgctaaggtcgaaccgccgagactccgtcgtccggctattacccgccataacaagtcgctagtcgaaggatggaatcgcagcggtccgagcggctctcctctgatatcccggcacggcctattgggattaaggtccgggcctattcagattacggttagagtcctcgagaaacatttcagtctctctggcatctgacaacggctacgcgccactcagatgccaaaacagactggatgcgtttccaaaggccatcgtgtctaacaaaggccagtccctgtaactaggccaaacatctcatcaccgtccaagtcacaggtacttcaggtttacggtcgtctgctatctacaacgaagaattcagagccgatctcgccagggccccttctcccccctcccttcttcccccctcccttctccccccctcccttctcccccctcccttcttcccccctcccttcttcccccctcccttcttcccccctcccttcttcccccctcccttcttcccccctcccttcttcccccctcccttcttcccccctcccttcttcccccctcccttcttcctcccttccccccccctcccctcttcctcccttccccctcccttccccccctcccttccccccctcccttccccccctcccttccccccctcccttccccccctcccttccccccttcccccttcccctcttctcccccccccctccccactccctcccttcttcccccttctcccacctccgttcagccttccccctcccccctcccttctcccccctccgttcagccttccccctcccccctcccttctcccccctccgttcagacttcctcctccccaatcgccccccttcgcaacttgcgaaatctagtctaacacgggtttacttacgcggtttacattcacacagcgggtgcatgttttccgctgacatttcccaagccggccacaagaaacgaagcaaaaaaaaaaaagataggggtattaatgcgcgccacccgtcgctacgcagcccgactccaaatttcgaataatgcccttctaggcattggaccgccgccccactccccgcgcaatatctaggcttaatcgccaagattgaccacgtatcccttatcgcgccggccgttcaggccctccccccccccccacgcctctcgactcttttttttttccatgggccgtccagactgagacgacacgtagattcgcggtcgtcccagaataaaggatgaccccgcgatgcccattcccactcgcccgacgtctccctccgattcaaaagtactgcggcacgacctgcgatggaagggaaaaacacaccaaacggccttaagttttccggtttgcctttcccttccatcgcaaatagcccgcaaaagaaggatcgcatttccggccccgtccggccatcgcgactcatccaccggccaaacggggatatcggaccgcgagactttaacggctatgtatttccccacccgctcttctcagaggaatccccgatgcaatctagaagcttatcgttcagagcgtttcgggcacggaacttcctgagaatatagatcatctctcagggtgcaccgtaccacacaacgtttctgtgggaaaacggaaggccagtcactttcacgtagacccctcaggatacccataacagaaaaactcagccccccctcccctcacgaccattttcctacgtggaatgcactacaagtacctgacattttgcaaacagggcgccgagacgtccgatggggttccagcttccgtggcggacgaaccaacaccagtgtgggcgttcgcatctccccccccctcccccccccccatacatgaaagacctacgattactgcataggaccccgctcctgggacaaatactccggaaacctccagggatcggaaatttatttagaaggggggtggggtacagggcatgcttgcttaggatctgctcgaaacttgactataaaaggcaatctgactagaatcgccaaaggcgataggtctcagaagaaaagtaggacgcgcgggggagggataattgtttacgcgggggggaagataaatggcccacggcggaaacgagaaagcgcgggggggggttaggccttggaagggggaaagacgcattcgcgcatgtcagaattaagatggcttccctataagacgaacgcacggtttaacagaaaagcggacatcacgccggggtcgaacgcgggaaaataaaaccgttgcgggggggggggggagtccgaaccgtgcggcgggaaggctccgagtccgaccggaaacggaaaaaggcggcacggcacggggcgctcaacgcacaggggataggaagaatttcccctcggcccgcggattcggatcgcgctcgcgatccaccttttctccgccgactcgccgaccgcccggaacgccggtacttacgcgctggagaagccccgtattactcttcttcccggattcggccccggcgcttctgcgtctgcgcggcggacatacgcagttgcgcttccgtcgacgtattcaatgtaaacaaggaagtcggccctgcgacttccgcgatcgcgatcgcgaaccggtaaacaacgcagggggagcgcggagcgcgggcgcgggcagggagttaacctcgcgatccgaccgcgcattcggatgtgcgggtcgggggcgtagagataacgcggcgtttccgctccgggccggagaggctggcgggcgggtctctccgtacattctttttttttgcaaacgcgccgctgcgcgcctaaacgccgcagcggcgcgaaacgcccgcgctctctaagcgtccgaaggccgtacggacaccggtgcgtccgggcgctcggccgggcgaacggcggagcttttctttctcttttcagtctcggagaaaacggcccggtgcacacctcctctcgggagcgtcgcaggaaagtaagttcgtgtcactcaccacccccccccccccgccatcgacacggagtctgagcatgagggctttaataaaccgatttgaacgtgctacgacgagagtccgtgcaagtgttcgcgctcgcgcctatacgtactacgacagccgctctgtagccgcggtgtgtgtgggggtgtgtgggggtgtgtgtgggggtgtgtgtgggtgtgcgcgcggccgggacgggattcctgattccgtagcacttcatctcgaatgtggaattcggttccgacgggggccgttaacacatatacgcgacactggtcggaactcgcgacttccacggtcgccgcgtaagtcagtggtgcttatacgtgggaacgaagcgaggctaagtagcaggtcgcgaacaaggaggtggaccgcggggctgtttatatcgcatctgcgtctcccgcggggccggtgagctaacggctcctccccgtcgcgaaactgtatcccccgcacaaacacctggacgatccgcgagcgacttatgatgcgcgtgcccctcccccaactaacccttcgcgcgcaccgcgggcctcggcgcggtacgttctccacaacactaatcgcacgcattcccggtcgcccgtcgccccccccctcgcacatcccgcctcgggggagaggagaggacaaagtacgttccccgacttacgcgacggactcccccgcccgcgccatcgccagacaccgaaacgggaccgaagcgagaaagactttttaataaacacgttcatacgcactacgacgagaccgctcgcacgcggtctcgtacacgcacgtacaccttaacgatcgacgcactgtacgcgagggctaagagcgggcgagcgatccaccccgtttcgcaagaaacgacgcgtcccgggcgcggctccgctaagcattcgtttacacggcagtttcggcgtctccctcctccggtcgtccgtaggagccctctgcgtttccccgcacggccctcgaaaccaaactccacagactcttccagacgtttgcgacgctaggctggcccggggcgcggacgcggtctgagggcttgagccggtggctgcagctcgtgagagcgtgttcgaactctgaaacgtaaaacggtccggctcgattccggataacgcaaacgtcttttcccctcccccccgatccggcaggcgagaccttcccactcaacctcggtcccgcacgggcttgggggggggggggggagggaaatagccggccgaaccctactcgggcccggacccaaacgacatcgctccaaaagagagcgttccgtttgacggagcccgcggtgcgtacctgcacgggattccggatcccgatcccatagcgaccaatctcgaatactgaactccgttgttccgtcggaggccgttaacacatataggggcaattggtctgggctcacgattttcattgtcgccgcaaaagtgagtgtgcttgtgtgtgcaacaaagcgagaccctctaccctgttcgtgaggagagggtcgcggggttgcatatatgtggcatatgcgttgatcacgggaccggtgagctgacaactcctccccgtcagggaactctattccccgcattaccacatggacgggccgcggcgtcgcggcgtttcccacacccctccaccgaccatgccccacccccgctctcgttcgagaggccgtcccctcccccatttcgttccgcctcgtccagagccagcgcgggacttcactttttccccatccctctactcctatctcgttgcccagcccacgatcgctatgtacgcgttctctccgaggccggctcgcgccgagccggccagacaaagtcacttcggaactgacgccgaagtgagtgctgaacggttgagggggcggcgtatcgcggataagctattctcctcggagtctttttgcggcaggccgcaagcttcctcgtacccccctttcggggttcgctagaactcgatcgaaacccgagacgagttactactgagccgatccctacagctcgggaccgctcccgaacagaacgcggcctcatcgggttctttcgtagagcgccgcaagggcagaaacggaccgacgcgcgtccgagactcatcccgagctcacgccgaacggctttattgctccgcttccgaacgagagagcggtcctatctcgaccggcccgttttcaatcgattcccgaggttccgacctcgccgcgggtgcggggccggggggaaagtcggggggcgacccgcgaccgtgttccgcgagcggcgttcggccgcgtcgccgacgcggggtcggatctcgttctcgtgcgagggatcgggacgatccgcggacgagaacgatggggcgtcctccctcgacgtccgacggttccggacgccgcgagggtcgcggcccgaaggcggagatgccgagctcggccagttcgatgccctcggtacccatcccccttccacccgtcggcgacccccgcgaacgcgagccgtagacgacgttctcgggacggcgcgcgatcgcttcccggccgcctgcgatcccaacgggacgggttcgttcgccgcgcggttcgcccggcggtaaaagaacgaccagaaaatccgatccgcgacggcgggcgctttattaccgcggtcccgcgctttcggacggcgggccggccagcggaacgacggtccccgccggacctccgctcgcgtatttgtaggccggaggtccccgaatccgcccccgtgggaggggggcggcgtttctagcccccggcgcgggccgcggccggacacgaacacgtggcataggatcccgcttcccgattggcccggacgggcgttcgcaccttgcgccaataatatattatatatataatcttatattggttcgcggtgcgaacgctgacgcgttcgccccgctcgtttgcattgcatcacgtgatcgttacgccctcacgaccggcccggtcataagaagcggaggcgccggatctccgcttagagcgccggtccggcgcttcccgcgaacggacgcaaggtggcggcagaggataagcgatcgccgaacgagagccccgtcgggagcgatcccggatcggacgccgcggcgaacgcgtaggtttcggccgtctcccccttcccttcccccacacatcctcccgccccccacaacctcctccccggcggcctcggacggcgcctcccccgctcttcccgaactgcaggccggccggctaccctccctcccccctctcctccttccccccctcccccttcttctcccgtccgaccggcccggcggaacgcgatgcggcgggggaaaaggcgccgatccgacggacgcgatcgcgacccgaccgctgatccgcgcgcccctccggacgccgagagggatgcggagcgcgagagcggagccggggacggagggggcgacccggacgccggagagaacgacgccggagggcgcggaccgggcgcggacccgggcgacgacccgggcgacgacccgggcgacgacccgggcgacgacccgggcgcggacgcgggcgcggacgcggacgaggcgcacgcgcgcctgctccggcgcgccgagcgcgaaaacaagaaactccgaaggggatgtaatttagtgtttactataagcaacaaaaccctagtagtcggaacatgttttatgcttgcggcaggtgtactagtcggtgcaagtggtgctgaccacgagactgcatgcaacaaaactaatttgctgttggtatttgttactgccctcttgacacgatttatttgaaacggtaacgaatgctcgtgtactttataattgcatgcccgattacaatctgttctgtaagaatagttatacgtagcgtgttttacatagtcttcgatgtatagaagagacgcagtcaacttgccggtgccgtgaaattgtctccacactatgatgtttttactgttacaaggtaattaaagaccttcgagtttttcactccacttgtgtgacgctccttcgattatgagagtacaatgtcgtctaagggggatgtggatcaccacgcgggttatggggtggcactcgcaattattgctctattgctcgtacatgctactgcactgattatggtgagtgtctttttacctctgtcccatcagtaattgctaaacaatgattgttttaatgccaaaaatctttttttagatcttttctgatgtcaaattcagaccagtttcacaggatcttagtacgcagtacccatctcataagcattatgatgatgcgtactcgccacatatgtctggggtagaccacggccattcggatgtatggactaacactgtaaatgacccatccggcggaataaactcaaatttgcctggtgcgaagagcgtggagaagatctatcctagcgtagaaccaagtacgtcgcatgacaaagtgtcgtatggaaatgcatggggaggggacataaacaccggcagtgtttcaccttctgatgacaaagcattgcccgccactgtcgaaccatcgacggacatcgtttccatcgcgatcacggggagcagtttaaacggagaaagtagttggcggatttctaaggatggcccgcgtcgggtttatacaccacaccagactaaaagaagtcctcctcagatcgatggcacgcgtttatctactagaacggcatacttgagtgtgtgggatgaacaggaggggatttttaaaacgttcccggccaatgctgctgcattcaatttattggacgctaatcagttagagaaagcgcgccgtgaagtttttttcgttgtgtcggtgtggcatggaaatacgaacgaaacccgtatatttttatccgccacgaggctactgacgcgaatgatgtccacatcgctcgtcgtttatctttcctgggactctcgaggggccctggggacgacaactgatgcggcttttctggcacggagcgtaaatatatcccagttcctgaccgctgtaccaccacattcgcaagttcgttgtatgggccattcattaggaatgtatacttgcggttccatctgtagacaatataatagtgtaggtacgaccagatgcaaaagcattttaagtattgatccttacggcgcctcatcacccgagtctcatgtatcctcggcagacagctcaaatacaatacgctttgatgccgactatgttgcgattttcgcaacaagtaagtggcacttgaacacgtccgattcaaacgcagacgaatatataatagtagatggcttgaatgcaaatgctgtgtgtgtcgatccctacgagtggagtgtcttattgtgtgttagcaatcgccaacgaaatgccgtttgtgagcgattcggtgctaacaacgtaacgactaccggcgaccctgcggaagacggttcggaaacatgcatgcgaatactccctatactatcggtgctgcagtcgctcgataagaattctgcgtatccgctgttacgtatggatccgccgggagcttctgcagcggtaccatccttaccgtccacatggaatatctacgtgatgggaaaggattacagatattctacttatggaaaaaatgagagcctgtggtattctagcgccgtgcatatgggaggaccgggattctttcctgcgtcggtatttactgtgtttcttccctcgggtatacccgctgtggtatccaatgtcgtgcaacacagtagcatcagttacggagatgtagcggttcattccgctttcttaactgataggtccctctactacccccgagtgatggtccaaacatccgggcctattttatctgcctattcttggagagcgcgactgcataatgacagcctctatttattaccacttccagaacaggagataatgcaatacaaatgcgcagttgcacagggaagctatgcatgtagtcccacaggcccgatcttgacaactgttatgtggcgttcactgttattcgcgggcagatcttcgccggtgcccccaaacggtagttgtttgacttatatccccgctaacacaatcatccggagccggtcccccattgaaataggccctcgaagtattataactgcatcgtttcagctaagcagacaattaatggctatgacgctcgaaaatcatttcacgtccacgaaccggactctattgacatttcatgatgtgtgccacgacactgctatggagtcggatatatacttcgagtataactggttaggcgcatcgatgaacattaccatactgaaccccggcctctatacgtttagatggtttttcccatttgaggttttcgtaatgccggtggtagttacgcctcccaagtccagagcggataccgtcacgatcgctcccgtaggactataaccctgttggacaaataaagtatacagactgttcaaactgtgtagtgagtccatcttagtcgtactggatgcaaacgagcccaataaagtgtaacagttgggaaaactttaactgtcgtgggataacccttataatgttatagtgcagtgactgacttgtaagcaaacattgactggaagttagcttatactgtacttcgtcgagactgccgttgccgactgtacgatggagcggcctctcgatcgtgactatcaaagtgcgataacgtgcttgacgtgcgagagagtacttttttgtcgcctctgacatgggcaggttcgtggcgataactccaactacatcaatgccaagaggtttaagcgttaggtcgccggtttaaatactcattcggaagccgtgggtggcgcctcgcgtaccccagaccgttgtgttataaaacccagactcgtcgccacacatgtaggcaaaaaaatgactagcgaaagagctcttgcgctagcacccggtcgggcggccacggcagatttctacgaagtggatccggtatatcggcgagacttcgcacgccggcttttacaacgtaagttccagcttgtcgtgttgtagaggtatttactactctgatcttcacctaattagcaccatgccgtttgtatttaggtttattccccaagacgcttgccgccgtcagggaatcggagggaggccgaaacacgcgcccgcccaaaacagatctgtgtacgcttttgcgcataatcgcgcatcatgagaccccgcacattttcaccccaggtcccagactcccgaaatcctcagcaattgtcgacgggctatgggtagcgtgtcgaggacttgcggcagagtgcatgttcgatggccgggcgacaatagagttagcagaacgcctcgcaacttcatggttgacggccataagattaattctagtttggcatcccgtgtatgccctcggccagcaacacgaaccactcgagcggatatgtcgccaaggtcgagaatatattgctatgctctcgggaacgattcaaacatcgtatgcgacatggccgttttggcaaatgatgcaacgatgcttagattggtgctgctcatttcacatccccgatgaccgttcttgtgagcacggatctccacgtctggggatccaactagagggcgaaaaccagatattcgcgccaagtttggggctctactccgctgtaatggcatggaccccaattccatgtcacgtacaggttcctgtatttccgagacctggcgaatcggacgatgtctcgaccccgcctagtggggcacagataggacgggtgcgacctcacagtcttcaaaggctggcactaaaacacagacctattgatgccgatgtacatagacccatgccgttaggccggccactcccttcaatgcatatggacgatccagacgatccgcaacctggaccctccggacaaggccgggcgcccagaactccaactctggaaggagtccgggtcgcagaacaaccggtaagtcttcgccgcgcaagaacaccaccgccgccgctcaatgtcgacgaagacgacaacgatcttcctcccggccaacccccccgccctcatcttcgaactcccccatcatcaccatcgtcctccgagactgaaatcgatgaggaacttaacgcgcaacccgatccttggggtacaaaccgtagctctacccctacagataactcctctgccagtgaggatgaagccagagggagcgggttgccccgaccattgcgcagcgcgactactgaaccgcgcgtaacgcgtagaagccgccgtgaggctcgcagccggagccgaagtcggtctggagaccggaggtggggaccgtcccgattaaggtcaatgcctggacgcaggagagcttctcgacaagatacagtacttgtagacagttctgaagaggaaccgtagccgtttgtagtcagggttctagttaagtaggcgccgcgcgatttacgaattagtacatttgggccctgccgcgcagcgagcgtctcacgactgcgatagtcatgcacgtttcgctggtatgggtgctgtgtttgcttttcggaactagtgggggtgttttaaagtggtctgacgttgacttgtcgcggggattcatttcggtcccaaatgtaagttcgcttatgcttttagactgcgctccaaattcgatactctcaactgccagattcgccgatctgacaacagatgatgtccctaccggtatatttattaagatcaattgcagcgttccggaattcattttatggtatgggtctaaaagcgtggcggcgcggctcaacccaattattgcaagcgctttaatgatggacgatgttttaaagagcggattggacgattccgtgaaggcggaacttcgcgtgtttttaaaaagaatatccgaacggctaccttggagctctctccggaaaagacacggttgtctgaacctggacgcaccttatgacttctcctgttatggctcggcacggctcgacagatttgaacgagacatcgaggacgatggccgcggaatgtcatgccgagctaaatcaacccgagctaaagcggcccgcaccaacgccatcgagggatagttcggccgcgattaaaaagcgtcgccggccgatcggacctccgcccggtttcgcgccactgggcgataatgcgccatccccacagggtgaaactgacgcgtacggacatcaactgtcgatgaccgaaaacgtccgcgctgaattgtggcctgttatagccgagtcttacaacatagactggagttggaaagattggctgctccccgaattatgctgtcctaacggctccaagttgttggcggaatacgaacgccgtgctgcggtagaagacgtctttcctccgcgagcagatattttcgcgtggactaagtactgcgctccgcccgacgtcaaagttgtgatcgtcgggcaagacccgtacgttcatccgggacaagctcacggcttggcatttagcgtcaagcgcggcattacaattcctcctagtctgcagaatatattttcggcagtcaaggcgtgctatccctcgatcgaactcggagcccacggatgtctagaagactgggctaaacgcggagtcctgttactaaattccgttttgacagtaaagaagggggagcccggatctcatcactctctaggatggcaaactctggtgcgaaacgtgcttcgaagactgtcgttgtcgactcgaggcatagtcttcatgttatggggagcgcgggcacagactatatattttcaaacggatcgcgacgatcgacatttggtgctgaaatacagtcacccgtctcctttatcccggagaccgtttgcgtcctgcacgcactttaaagacgccaacgagttcctctgtaaaagcggtaaagggggcatagactggagcattggcgcgtaagtgacggaagggttaatcatcacatgcgtacaaaagtcgcagcgctctaggacttgtcgctttctgcgcgcgcaatgaacgataccgcaccttctgttttggcagtattatccaactggggttggaagagcacacccttgggcaccgtaggccccgtcccgattcgcgacgagactgagtgcgcgcgcgaagaccttccggcacatgattgcgaccactggtgtaaaaccgccaatgcagaaaacggacctatggcaccctccccggggaatcgagattttgcgggaaaccaagaatacacacatttcgacactctgtttatggtctcgtctctcgacgaattgggaagacgtcaactgacagatactatacggagagatctaaggcattctctggccaagtttacaatagcttgtactaaaacctcctcgttttcttcctcgcacgccacgaaaaaggttcgcgcgaaaatgtttcaaagagggcgtcagagcaacaagagcttgcagatgtttattttatgccgcagggcacacgctaaacatatccgggcccaactgcaagcggtaattcaagctcgaaaaccccgcaagtattacacccgcgccgtggacggaactacgcatccggtggtgcccgtctttgtatacgagtttgccgccatagacgttgtcagtttgcatcgagacaacgtgatagaggtagacactcccggctcgtgagcttctcgccgctcatcatgttcgtcgtttcggcagctttagcatccgcatcagactacgccgcgtttttgcgggacaacaagcaagctgctcgcaagctgcagtttccgttgtccccgatgccgagccaacggatcccgcatctgtctaaggatggcaggactgcagtcgcccgggaaacggggtcgagcgaggttatgtcagcgagcggacagaacgcgtcgacccgaccggtcgacgctcgtttcgccaacctagacaccgagaaatgacaagaagcatctaaaacgcgcttgattgtcgagtggctgaataaaatctttattgatcgactcgctttcctatttctgatttaataaccatagatggggcggggaatctataaaataggcaaggtccgcgcggattcgagcacatcgaccgcgtccgcgacacagcatgcaagtggcgacgaacggtcctcaggcatgcacgactggtctatctgtatatctgcctcgcggatcgcttccgtgagaaggtcttcctcgtacccggttgagaaagcgtccactttcgagggtccgtacccgtgcacagcgccaatttcgtgcgcttcgatgcacttactaatctcgggcgcgttttcgggcagagatcttatcggatcgcagctctgtcgatgcgcatctttattagggtctgcgatcgcttggcaatacaatcgcgcgctggattcgtgaccgacccgcattgcattggctgtttgtgtcaaagagccgggcttaccgtagatggtgatcgttatgtacagtgacgttcccatccacataacggttaaaattcctccggaactgctgtataagtaggcatccggccccgtcacggtacacgtagcaaatggtatgacgcacagggattcgggcagaaaggagagcggcgcggcatggtattcggcgccgcactcgccgacgcgtagaagataagagcaaatgtccgcgccgctgtcgacaatgatcagggtacctaccggtcctcgctgtatgataaagttcgacgatgggatatgatcgcatctggtcatcttaccaacggcaatcgagcgcgtaccgcctgcacatgagcaaaccatctgctcataaggaggcattgtccacgcgggctgagcagtgacgttctcaagcgtatacgcgatgaacgtggaccccatcatatccacgtctcatgtgacggccctatgcttcatggccctagttagtatacaatgtggactttcggatcccggagggcggctaataagtgcgcgctgatattgttatcatccctagtatgcgtttcccgaagtgggttaatgttcatcctcagaaacttagaggaggtcactcgagacatggccacgtagacgctgctgagtttgatgcccgattgggcaaaacatatagcaaccctctcaaggctaagcccttgcgatctggcgatagtcatcgccagtttggagcttattccgtagtcggcggttacggccatccggagttcctgatcgtctaccgtttcgacaaaatcattgacgttggtgttaattgctgccatgaaaccgtgttgatctttcaaaaccagggtcggcatgtgaagttccccgagcgcttccgcgacctggggatgtatcttacgtctaataggctcgtctgcaaatgtgttaattctagcgtatgtgtaacccatgagagtgtagctgtccgtctgcaaagcgagcgatagcattcctccgcgcatgctatttataaatatttcgcaccctttaaagctcacgttgtcgacataactatcgaatctggacgctgcaaacttttgcccgaatagctccgtcaggatagaatacctgcccataaacatgctcttaagcatgctgaactgggtatatatctccgcagaagtttctgcgcgtccaaattcgtaattgcaataaagcatgtctatcatctggtcgtcgaaatccataaatagggcatcgtctgtatcctccacatgactgatttggtcattagctatacaatctaattccttctcactgccatagcggtgtcctggaatcgcgaacgactccctctgctccgctctatccggaggttgccgtcccggatagagcagcgcagaggtaagcatcgccaatctatcgtacgcgcttttaacagaattgtctggaagaccctgccgttgcagatagttgtagaactgtatcatgccgttgaaaagcagttgagataagaaacggtacacgtattctacagacccatctccgtgcgtctttatgaaggaatcgtctttcaatacggatagaaatgtctcgaacgtcccgcaaaagccgaaaacccacttccgaagtcgggtagtaacagccacttggctgtttaagacataggcaatatctacacacgataccgcgagcccctgttggctgcgaatttcacatttggcctgtgtggcatcttggtcgcgactttgcgaccagttgctcaagcgtcccgcattggcagcaagccatttttccaacgtaacgtgcggttggttggcagcagtacgatatcgttcgaaactatccaaactgacgaaggtataagccggcagggtaaacactacaaatttcgtatttccggacgttttcaggtagtcgtgtaatctgctcatgtacgcgctgacttctttatgggacgaatacagacgcgtccatcccggaaggttcgcgggattgttgatgtatgcttctgggacgacgaaactatctacgatccgagcgtgctcctcggttatgggaagaccatactctaaggtcttgaggaggtccccgaactcgggttcggtgcaccgtttgttattaatgaatatcgcccagttcttggacagttctaagtacgagcgcaacgtctggttgcatataatatacgtaagaatattttcgctcgtacgcacattacacttcagcttgctatgctcaaatgtggactccaaagaattcgtttgcgtgggcgacccgacgcatatcaataccggcctccttcttctacagtactgcggcgtgcggtaaacggcgtttgtgagccaccaactgtatacgatagccgtaagcaaatactttcccagaagtccagcctcgtctatgacgattatgttactgcgagtgaacgagggcatcgaaccatgtatgccgaagattgtccacgccatactaccgcgaggcttgcttagcagatcctctaacgcgcgaatcatttcaaaccgccctggcccgacctcgttagacaccgccttcaaggcgcattttgtaatgtcggataaaacgtcccaataatacactatatcctttttctgcaattctttcatcgtcggtgggctggtcggacatacgtactgatattttcccaaattcgcttgaatgtgattacctttaaacccgaattcctgaaatatcgtgtttatgtgctgcgatgtgtatgaattgctaagcttgcaataaatattctgcgctgcgacctttgtcgtgccggtgataatacagtccaagatttcggatagcatctgtatgcacgtgctttttcctgagcccgcatttccgcttattaagtaaacggcgaaaggtagctcgcggagttctagatccaacgggctttctagttttgacgcgttcataaaatacgatagcggggggactatatcatcgctcaccgatgcgtccgccaggctccttacacgcgcaatgatagtctgtatcccgtgcatcgcagtgaaatttagatacgttgcctcactgaagaaatcgttctcccgcgacatcgtcggtcttggggaagacgggagtgacgaatctacgtatcttttagggtcggggctggcgtgttgtttatttccgatggagagctcagacgttcgggccgcacgcagtcccgccctaaaacaaattcgacggccgcagttgcaatctgtcacgcgccaatggaaactttcaagcgacggcgattcgcaacagtccctggaacaggactggataataattcaccctactcgccaaacacgtatgttcaaagaggtcctcaccgggcaattgggatatacagatggacagggcatatataactcggtacgatctacagaagccgcgattcggcagattcaaagtaccattctcaccctttctttagatgcggtcagatatgacgacttgaaagaggattggtcgaagcatatggataggcgtgggatgtcggccaaggaaatcgcaaaaaagtatggcgttcatagtgaagccgaagctgttagaatggcaaagggggtgttttcaacttggcgtaaaactcttcaaatgaccttaatagaattggttcggcacgcaacagattgcttcgccgcggccgagaaaaccacgtcctgcttctctaaatacatagactggatctgctgtttaggtatcgttccggtcgtcagaagcgagcgctctatgcaggcgtcgcggccggatagcaactgcagagatcgcgctaccattcgcccgaattgggtattcagcgatgccaccgctaagctactagttgcggatagcgttatggcccgcgcacaacaaatcgcggattacttaactgcatccatgcaagcactgactgtgatagaatacgatagggcccagatagaatataatttcttaaaacgtgaacttcgcgttaaggacgtgttgagcggcgaacgtggcgagtgtatcgttatttggagaccggtaatgaacgacggaggggtaatttttgattcgcccatgcagagaatctacaaggagatgattgaatgtcacgatttgcggatgcatgcggcgctgtgtcggctagtaaacacggcccctataaaggtcctcatcgggaaacgcgatgaggatagtaaaagcatggccggggctcaaagagcaatcgataaagttctgggagaccaaactgaaacggcggcgagctctgccgcctctaggttggtcaagcttataattggcctcaaaggtatgcgtcatgtcggcgatatcacagatagagtgcgggattacttggaggaaaccggcggacatttattggatgcctcgcccgtggatacatctcagcctggcttcgggcgcgctaatcgaccacagagttctacgatatccgatggaacttgctccaataccgctagactacgtgatgcgttccacgcgtccgtcgtgacgagtataaacgaaatgttagagggctatataaataaacttttccataccgtggaagggttaaaggcggccaataaagacttatctgcaaaattaagctctaaagaaatagagctcgacagaatacgcacggaagccctgatctcagaacgggcgcgagctgacgcctcgtgcgatcctcactgcaatccaaccatggaaactttggtgcgcgagctaaaacatgacgtaattgacgtaaccaatgcaatggaggatgagtcctatatcgcgaatagcttccagtctcaatacataccatcatacgatggcgatttgaaacggctctctaacatttgggaacaggaaatgttgaggtgctttaagatgactcgtatcaccagtaatcaaggtcgagaggtttcgatctcctactcaaatagcgctataactttattactcgccccctatttcttctccgtgttgcagatctatgatattggtgcgatggtcacgagccaagacgtttacaagtcggaggaggagttatgtaattccgtgcttgaaaaaacccgactttgtacatatctggatgatttggctctcgtctttgaggccgatgtgaaaagagctgtcgcgaagtattcgctccgtgcgggtaacgccgaaatagacttagcgcccgaggagttttcgtacggctctcatggaagcaaatgcgagacacggttttcatccgctagacacgagcgacacgttggacgctctagttttaagcacgctaaatggagaagtcggccaaaacgagaccgtagaagaactaatttggcaaccgacggcgcggatgatgatggagatccgagagattcaaggcggtcctactcaattcacgggcgtctccgtgagtaaacttcgcgtggcaagatgtgatacgcgctttcatctgactttaaccggagccgacttggatgatgaaatggcaagtgacgtataccacagtcagtgcatagttaattcggcgttcaaaggtttcgtctttatggttctcacggttacggaagatatagtgcggacgataggggttccaccccctctgctaaaatacaggctcgtgttctataacccatctgaacatttggacttcgcattatgtttgctcgtagcctatttggagaatctccatgcaagcgcctgcgacgtaacttttttcgtacaggttcaatcttttctgagatacgcatggacacgggtgacgccaatgaccaaaatgcgcagatttttatgcgccacgaacgtttggttactaaacactttgatgtcgatggggtcctgtagcccattcgacggagatcgagtactcccccattatgcgatatacagacatttgtgttctaccagtggcgtctgcgacgtgttactaaccttgtttgaacccgatacacggcaggtacgtgaccgcacgcacggcaagggacttgtcatgctcaacagaggaattatgaataaggcttttcggcagacatggattagtgatacggtctacgattggtggaccggcgaacgcgagaagttgatcggagaagaatctctgttcaacacgtataatatatgaataaagtatgacaggcactgctataaatagaccgtggtttcttagcgttttcatttatttattgcggacgaacagaaacctgtacggctctacgtcgaatgtgaatttgctgagatcgacgttaggccatttcgatgttagagcaccgatcagtaatctcgaaaaaatggacattattggtttcatatgatcgatgcacgcgatggcagggagaattacttgtcccccttcgaaaagtgaacacgtgagaggtgctatgctgccgtccacagtcacggtgtggacggcgtcgttactgaaggcgctcgtatcgaatctagctgccgcccgtagtcccaaagccgtgatatagtgagtgtggtcgcgcgattctgcgggacagctccaaaagcaggcgtctccgcgggcttcgaaagccgcggtcacgagctcttcgaacactgcacgcgatcgttcttggattgtccgtagggactcgtcggaatcgttgcatgcggaaatttcttctaaaagggcagacaaggctttcttaacttggcccgcaaacgcaggtcgggccggaaaccccacgaaatctgtttcccgcttagtttcgttccacagccagtaacaattggcattccacgatactgcatgagtgtataccccttccattcgaaactctaatctgatatcttcgggaaaccgtagcccgactgacgtggctaatttgttagcgctcttaccgcaagcgactcgtagtgtttctaaagcggtttctgttcctttagaggaatgcagaacgttgttggccccgtccgtgaatgtcccccacagtccatctttgacgtaggtacacggggcgaatccgagagccgacgcggtagcttctacctcgagactaatatgattcccgatacagataatagctctataaacatcttcacgcactcttttcaataggcctccgaactctatgatgggctgcttcaaccagtttttctcgcgctgcagtcgagcttttaccgcggcgcgcaaccgggaatgatcgggaaacagtcctagatatagagtcgcaaaaaaggcgctaaaatcaaactttgcgatatacgcttgctctatgaaagtcggttcccggaaaatacaagttatccgcccagccgtccagtcgtcggctacctgacgccgcgtactgcttgtgcgcccttttaaattttcgagtacgtctataccaggggtcggatgggtttccggatgccaaggagcaagcaggtggaaggttctcggtccggccagtggccacaggccatcggtctccgaatagctgccgacggcctttctgatggccgagggggccgccgtagatgttttcaagagcggccaaaggggaaatccgatagtgcaggcatagtcaacgtcctcgccgcgcggactggtttcggggccaatatatacaaatataggggccagccttttttccgagtcatcggctagagagtatatttttttgtgccactgcgcatagatggccaataatgccgtgagagaaaattcggcgggtgtcgtaaccaagcagtcaaaagacgtcggaaccggagccgcggtttttatgggtgcctgtgagtcgggtaatgatagaacgcgttcgacgatagtgaatattctattcgtatttccccatttgattttcttggacctgcgacccactgttttatattcgcggatgaaccggtcttcctttgtgtaaatttcgatacgggagtcgaattccgggatcgtgtcgtcgtgtttaagagccgacaatttaatgtgggctaggtgcgcgccctcagtatactccatagccgtggatacgaggcgtgattcttctacgtgcacggcaccgtccgtttttagtagccccggacggggagcacatcgatcgcccggcagaggttcgcacgatataactaatcccgttgttgtgtctacgtacatatcgacgggtgcgaagtatgcatgataaccgagcttaattctcaattttgccagcgtcacggcgagcagcgctttccatagagcgtgctggtccggcctgcaagacggccaaactcccgtcacagatccggcactggccataatcgccagtgccgcgtcggttactgaatccggattcaatccccaagctctcgcgatagaccgtcccgatacgtttaccgtagagtaatgtgcagaatacgtaccgcactcatttctaaaaagcaagtaacacagtgcggtaagaccatcggtgcggtctctactagtccatactctatacaaagtggtatagcaaatacacccccggattttctgtaccgccacagtattagcctcagccattgttgacataactaggttcgctgcgtacgccttacaaactgtgaaaatctatagcgccctctacacgaggccagcacgccgggggaacttctgccaaaaccgtctccaggtccaaaatgtcgtggtatatgcccaattccgcgtccaagcgagatttcactagcgcgtaccacttagggcgtcgaatctcgtagcgcgttttgcggaacgacgctttgtttttcataaggagtgtgtaaagcgcgcggtgcgttttgatcgacgttctatctatccccgccccatccaacaaagcttctatctccgcctttcggagattcttaactttggtgccacccggaaacgtcgtcgcgctctttacaaggcgtaacccatacagtatttcccatgtgactttaaaaacagaaaaggcgtggttctcctccgtctgccggcccaagggatacctcgcgagaccacttaacgcgcttttcgttgttttgactgatcgtttagaggcagtacgggcatccagcagataacatcgcgtgacttccaataccgaacgaataaaagtatcgtactcattttgcatcacacgcagcatcgataatggatctaaatttttagctgttccctctaaagggttaatacccaacgaggtcgcccatctgcagcataaccgatataagtgccaccttccagacacgttgaaatcggccgttattgcgacggtacccagccctccatcgggcccgattattggtaagctgcctgatgcgtaatactgataaatacgacagaacacctcttcactataaagagcggccggcgttgcgcgacacgcttccaacatcgtaatatttataaattgttctctagtaagcggttctgccagtttagttaataattgcgcaagatcgctcggcgatccgtcatgtcttagatatttatgaataaacggctccaccatctcattgtcgatcagatcagcctggatttgaccgcaggcaattttacggaggtgtttcaaatctcgttgagcgataagggcgtctgccgttaaatccgctaagaaggcgcagaaggtttcagcgtccaattgagagtcagatccgtcaaatctgacgcttattagattcgcgtcaagtaaggcgtggagaatattgatgctgtcgctaagattgttgagggtgcaccgttcaaacaaatgcttgtacttaaatcgtgggaaaatgtataacgcgtcggcggacttgaaagtcggaacgcaatctcttctgaaattgttacacaacatattggtcgcgcatacgaattgcgccggccatcctcccccactggcgatgacgtggtttagtagcatgggtgtgaaaactggctccgaacgagctcccgatgcatctatgtaaaccaagacttcgttacggcgtaacgatcggattctacctaaagattgatagaccgaaaccatatcgggcccgtttcgcgtcggcttaatatacgcgaacatgctgtggaagtgggagctgataaaacttaggcctactgttactacggtagtgtagatgacaactcggtaacgagtccatgaatttatatcaattggtatatcacgggtggaatttaagaccaggacagaatcggtaaatatgaggcagaagcgtgccgccgcttccgagaatgaaattgtcgaggaaaataagcaaatgttcaacccgcccgcgagtcttctgctgagttcagaaaaaaacgtcgtctcagtcacgcttctatgccgagagtgggtaccgtcagccccgtgtttaggtgtgggtcgtacatgaaaacaatctgattggtcgctattcatgacggagagaagtgtatctgttcccagattgcggaggatggtacatgatctcttagaaaacccaggggctgcgtattcgcccacgatgacatgtatgttatcttctcctctcatgcttgccaacatatctaccagttgtgtatttattgtagcgtccattgctatgatcctcgggcaattacgtaacagagtcgttagtatcgaatcgactctggacagatgcctcatggttggagagtaaagttgactaatggtcgacatgacttcgtccagtatgatgatttcataccgtccgagcaagtcagggtctatgcgatgcaaagattcgatttggatcaacagtctgtaaaactctctgcctcgtatgctgtagtcactagccgtcaaatagttgccgaaccccgacagcccggcattgctcagtttgtcgaataatgtgttcgtaaaacttcgcctacaggacacaaccaaaacgctcgtgtccggattatataaaatacgctgcaaccagtctatgagagcagttgtcttgccggatcccataggcgcgcgcactacaagtacattgcgcgctctcgaggacagtggcggcggaaaagtaacgggcccgtcggattggcgctcggtcgttactccgggtctgttcttagctatccaatctatgagaccttctccgtataatatcctcgacaaagaggcgctacagacatagtctatcattttctgtgcggtcgatgctctaacgtcgccgagaccggtgctccgggtgaggattacgttctgacgaccagagaaccgtctacgatcgtcgctatgtcaaaaggaccgcgatcggaaggagcccggagaggagcagatcatatagactacattcacaaaaagatgtgggttgtccaggcggcgtgtttttctgtcgccgtcttggttttcctaggaaccctgatagctgcatctataaacatgaccgaaggtttcccatgcttttttgcggccgtcgtggactacgggatgacgaacgtgacgcttgtgcatacgggcatgaccaatccgaggctgggaggcgtagttcctgtgctgtttttccaaaccaaagccgtggcgtttctcttctattcggcgagcgtcgtttttgtatgcatcacgtgttatatcgccgtaggcgccatcataactagcaagaaacgagtgggtgctgcgtataccggaaggggcgcgttcgtcctttcacttatggcatcgccctcgacaattttgttgggtactgtgtcgatttggcttcttcaagcggtagttatagtcctagcccacaaacttattgtactagccgcggcggtttatttagtgcacttctcgactataacgtttttttatgggtatttctgtggaaggggcgttgacagtaaagtatatgcggaagacatcgctgctgcgaaaaacgtagacgccggtctgcacagattaattggaaacgggcgggcggtcatgatcaacttggtttcgatcgtatacagtatgcttctgataatggcgtctctaatgttaggcatgttactagcaaacagctttaccttaaagttttggcatgtcatcgttaccgtcctcataacttcctcagtcttaaccctaatgtatcttttagtactcgagttcctagtggcgcggtacgtgcacatgattttgggtgcgtacataggccttctgatcgcctatgggatgctctggaccacctcatgtgattatgtcaaccggttctacttcgcgatgggcgtaggagccggcaacttacgcactgcctgtcacagcgtgctggcgtttttcaccgtactgattgtagcgggcatgattgttcgcctaatccgggccgggttgtatcaccgtaggcgatctactcgtgcatacgccaaagccaggcagttacaaagaaatgtaaaggagagattgagacgaatgagtcggggacgcgatcgtcccgatagccgagctgaggacgagcgggcgcttacgcaaacccaatatagcgaaacatcagacgacgagactatatatgatcgcgtttattcggggtctgatagtgaatgggatgaataggaacgcccgaaacataataaaacgctaaatctacaagtgattgtcgcgcgacttatttatcactataacgtatcgttacattgttcccgaccgtccttaaatctgaaaagcgtctttcctctcgcgcaagtacttccagctaagacagtatcggaatggataagagggtcggaggacctaagaccgtccaaatcgacggtatcgtattgctcgtcgtcgagctcaattacatgtcccgttttggtcagaacggtgtttcgtttccgacagcgtcggaacagttccgttacggatattgcttggcccatacttgctgcacgagttcaccgaacgcacggtatccggcctcttctacttcaccgtagaatgtaacgtccacgaccacgggagtgatgaggaggagaacgggaatcgcttgttcggggtctattttgacgcttggagtgggttctccagtgtttccttcggagatcgtcaggcgtctacctaattcgccaggtcgtctgcggcggcctataaacgtggcgaggtgtgggatgaccgggttgctttcaaagtaattagaagctacgtagttctgaacgaaaatctgcttgaaatttggatgtcgtgggttggcaaatatgggcacaaggacagattgttctccggtactccagcatagcgggtgtatcgcgttcgtttgcagatcaggttcgccaaacagccatacgcgagaactgcagttcttattggaggccaagtgacgcgaatcaaagtcgttccgtttaatgtttgatgaaatggcgcggaagcgtgatagccccactttccagtcgtcgtcacatgtgattagcgcctcctttgccttaggaaaatcgtcaggtttaaaatagtccacgcaaggatgattgatggcgtataagaatcttcggagcgctgcgacggttcttgtttgtaataggcgttcgtaacattgagatagctcgcttcgacattccgggtaaaacgcgtatttggccctacactttatttcgtacgtttctatggagtggtcggggagggcaggcgtaaggattccgcgtgcgctgcgagggcataccgccatatcgagggatgctccgagcatcccggttctggcgtctatcatcagaccgcacgcgtatttgtcagaggcggatgagacggtgattgtctcgtccggtacgcgtgcattttcgagcacccgagaaggttcgcgaggcctgtacctggggttctccagacaataggtctctatgagcgctctcgcgagcggctcgttacgcgttccgaagactacgctttcgggcattccttgcgccgtgatttcggcaggtcttatgccaacggtgtttatccgtccatcggcggtccacttcaatgtcgatgcggtcaacagccattgtctaagtacgtgccatagctcgcagtccgcttgcggtctggtgagagtttctacaattttacaccagaaaagcgcatgattagacggcgacgttgcatttgcgcccgattcatacaggagcttgtcttccgcctctaggagagaagaatatgaagatgccggccaacgtccctctgaaatgcctcgtttgataacgtccgttatgtacaataagcggtgatacagcgggtgtggcgagggccccgattgcttcgggtcgacattccgtaatatatagtcgctgaaggtataatcgaccacaacactgtagcatacggtatcgtaaggtttggactgcactgcttctgcgtgctcggcgcaagcgaagacctttggacacgatttaaattcggactcctttttacgtttccgtggcccgttctcgccgagacggaacattgcggtggagtctatttccataacagccgtgtagcggccctcgcttctgagttcgagtgacagtaaagtgcaacgagctcgaaaagattgcttaaatatggcgggactctcaatgaatcaaatagcttcctgtgcgtcacttcatatccttctaaatatttctcaaacgcgaccctgtggtgagagccgtgtagctgcgaacgaatcttttcggctcgttcccacgggataccgattttggcagttaacggggtagctggaaataagtactggtacagcatacaccgatacgctaacatgtctaaaagatagtcggccggcatcattttatggtaataaaaatgcaccgggtttccggggatggcaaagtcccgcgtaaaattcatcccggcggctagaagcacttccatcagtgattggcccagtgcgtacatatctatagcgacaccttcatcactggacagttgacttgaaccccgctccaagcccgtcccgtttaaggctttaaccagcaattcgcagggctgcgtttgcccatgccccagcactaaatcaaatacaggtctaatgtttgctctagacacttttactgaatatactcgatcggagtctacagttatgtcgaatcgggctttcgtaatggtggagtttgtgttaagtaacgccaagctaaaatcgccgattacggcctccactataatagggttagacccttccctgacgttgacgaaaatgttcccgcacttaatatccaaatgagtcagtccgcaggacacgttcaagtacacaacggctctgccgaggcccatgaacgctttttctatggccctccaatggcgtgcagttttatccatcttcctcagtcgatggcagtacgagtccatgtccatgtcatacgctggaaataccagttccctggatggtatcgaaaaggccagtaatgaaatcacgctattgagcgctagagttgaccttgcccgacaagcgcattcgccggctatcagtgtcataagcaattcggtcttgaaacactcgaacacctttttgacggctacatttgcacccttaaatactttaacttctccatagctcccgcttcccgcatatattggcgtttcttgcaggtcgatggtgctgtaatgtaagcccggggagatatcgaaaatgagcgatgttatattctttatgcgagatagagtgaaaatatgatccggcaaagatggtcttgatagcaaaatgtcagatgttttcctagatatatgtttgcgtctcctatagaattgttttaggcatctcctaatgttgacggagatgtgttgtttgtggtccttttttctacacgaatctcttcggggggcactgaatgttccctgcagatcgtctgttgtgcttgagtatcccttaggcccgctgaagtcttcttggtcgctgatgtcggaaagccatttaacgtgaggacactcgtcgttttcgcggccgcgccccggctttctggctttgaggtcaagatccattttgacagcagcgcctcgcactctgcgtccaattctatgtctggaaggcgatcgctgatgtcgtcgctgatttgcgttaagatgtcttcgtttgctagaatgtcctcttcggcacgatccaactgtgactggagcctagggtttaaaaaccttcggttcgcatctaagacgatgcggcggtccacctgttcgtctatgtggcgttggataattctcgactttctatgagcttcttcgatccgcatgttcgagtgcaactgggttttgtagtcactgtgggcgtttctggctgacgttaacgcttcgatgagttctgggtcgtccgcttctacaccttgggacaaaagtgtcaaggtgcgttccttataaattttctcccgcgttcgacactcggccaatatttgacgcctgcgtctgcgtattgtgttaacggcgaacatcgctcgacgagattcgtagtctggcgattaccgactccgtaaagatgttcggaggcgcgctcggagaatcggcgaagaagcactttgaacgcctgctgagagataggaacgagcgtttaggtgcgagccgtaaaaatgaatgcctcgcgcgcggcgggagtttagtcgacgccccctttctaaattttgcgatttcggtcccaaggcgacatcagacagtgatgcccgctgtcggtacattgcatgactgctgcgacggtactggtatttactccgcgatcgctacacgcctgctgtatgctggtatcgtaagcagcgaatttggtgaagtgcgacgcgagtcgttatctaacggtcacatatcgaaaaggaatcgggaggcgttgcttgcgccgactctgacacgcgtcgccaattccataacatttcacgagtacgacgatgcacaatgcgcggcgcatcgcaacgcgtattacagtacgatgaacactttcgggtctatgaggacatctgacgcgtttcaacagctggcgtcctttatcgatcgattttcaaaattattagctgcctcgtttaaagacgtgaatattttggacagaaataacgctcccaaacgagcacgaataaccgctccctcgtacgataagcctcatggcacgctggagctgtttcagaaaatgatactgatgcacgccacttatttcttaacgtccgttttacttgaagaccacgcggaacgtgctgaacgtttgctccgtgtcatatttgatatcccagacttttcggacgcggccactagacatttccgacaaagggcgactgtttttctagttcctaggagacatgggaaaacttggtttttggtgcccttgatagcactggccatgtcgtcttttgaaggtatccgtattggatacacgtcacatattcggaaagcgatagaacccgtttttgaagaaattggggatcgtctcagacgctggtttggtactcagtgtgtggatcacgttaaaggagaaaccataacgttttcgtttcctagcggatcgagaagtacggtaacgtttgcctccagccataatacaaacgtgagtattgcattcaaaaccgttgtgtcggatggtcccccccctatacacacacccgtgatagtctaatacacccttgaaccagtatcgaactccacatctccggcaggtagaccaaatgccatccgcatgaatttacgggaatcttcctactgtctacctcggcttcgattaactcttcgagccgttctgtaatgcacgccttcgtgccgctattaccgaccactcggacggcatttaccgtgtccatgaataaaacgcaacagaggcttttttcccctttgacttgtatatctgtctgtcgggctttcatccacatacacggacctctgcaaacacaagcctgcccgagcgatccgcactcccatctcacgttacaaacatccacgtgaaggtcgaaatgcccacggcattccgcacagccgctccggtggttaagaaattttgctagagtagcgcccagagaacgttgctgccaaccggcgggacatatagatagcaaactctcttccatcctgaggtaataaaacctgcgtttggaaagggaccaccaagctccaatagatatcgctatacagttgtgtggatcgtctggcggctgcgtgcgttggactagggaatttatgtccggtgcgatacaagagatagttgacaaaggttctatggcgacgtccggaagaccgatacaggtcctactaggagcgacgtcagaaaagaaaataagatctgcggaagatccgtcgcgcagaatgggggttatgcgtaaagcggcagtcacggaataggcgcgcgtcccgttgactaagaacaagagttgaaaagtgtttctgtccaagtacatctcctttggtcgcgtaaggtacatgaatatctccacccatttcgtcttttgcggccgagcgcccagcggtacgtacgtacataacgtaaagtctaacgtggttaatgcgaccaacacagctagacgcgattcggcccgaagcgtgcgccatacgcaaatgcggtcatttaacttattaacgaactcaactgccgccgtatcgcaagtccgttctgaacgacgcggcgatccgggcgtccttcgtcttcgcgtagtcatcgtcccacatctgtatgacgctaccgctaattgaatattcgagtcttggcagggcgctcatggaaaagataatgtagtgttgctgctgcagaggcgcgataaaaccgcgtccgcccgcgccagaggccaattgaactcggcgccggcatgcgctgctaacatgaaccccgcgggcaacacgattgcaacgcgcatacgttcatcataacctacgcaaatatacgcataactttctccaggaagaaatctttcacacgttgcgcgcgatacgaaccattcggggaatgcgcaggttctaatagattcgtcgcccggcccgccgggcgacaaatgcgctgcgtcacgcaaaataactgggataggcctcttatttaacatcatacattctccgcccgcgctataataatcaaataggaaaagattcggcgtcctagtagcgacgggttggtagtcgcctcccaggacttcggcattgtttccagtcgtatgtatgtaatatgtttttcctccagtgcgcttaacatgcctggccagaaacgagatgctcgcggacctaagagcgcctactgaaaacttctcaggcgaagaactcgcgattgcctgtagaactgcgcgtactgaatggggtgtgcggcttgcgatttctgccacgcactgaacgtctcgcgcatacacgtcgtagctgatcagctgatatagattgggccctgttttcaacgcttccccaactgcccttatgacacacgcagagacatacgacttgaaattaatcattaattcggtttcggagcccggagaaaacgcacgcagttggttttcctctgcttttaataagggagcagccaaaataggagcttccgttgcgatttcggtctttcttctttgtggtagacgagaggggtgatcgacgccttcttccatacaagcggtagcgagtaaattgctcaacgaagatggaattgtggcagaatcggaggaacggccccctaaggcaatcgaccgctcatacgatataagataaagtgtttttttggtcatggagtgggtacgtggaacgatggatatgcccccgcacctccaccggttcgcaattgtgagcccgtccgccaaaatgccgaccgcagaagataggaggtctttggggcttaacgaattttgcgatggttcatcgaacatgagaatgtcttccaaattcaatgcagtccctgtagattgctggtccttattacggccctccaagcccctccgagtgtcgtggtttctggcaaaccttcctttgcccacgggctcgagaccatctatgacggctttctgtgacacgctgctactgggtgtgcacaaattattttccaaacaagctatcgccccttggcgcaatccggacactacgctggcgtgtatattctccgccggccgttttgcgcttaccggcgctcgcctggtgatagcctcggctgccttcttaatgagatttgcgatctctatattgtctgtctctagtcgcgtgtcgagagtaggagtgtcgaagacgttcggagaatctgttacttgccgcataatgtcaaactgaccgggcagttcgacggcggataaacacgcctctaatttagcccccaattctataacagccgacggtaattcgacctcgtatctcttagtatatcgtatgaattgacggaagagcgtctttaagcggttcgcatcgatatcgtatcgagtacctggaggaactaattcctcttgactaaacagtaaatccatgtacgcttcgtactctccggtttccctatcctgtacgttaaagcgaatagccacggatgtaaacggatcaaagcggttcttagaatcatattgtatgggaagactcatgaacaatccaccttgatcgtttcgattgagcgtcgcgaaaagtttggcgtggcccgggacatgaggtatcaagagtatgtgtagtgcgccagagggaacgtaggctgccggtgattcgcgccaaccggaacatttaccggtggcattatagcgcatctgaacacttaccggaatcggcagcgattggtaagcactgctgggtactctctgtgccgcatccttaaaacgggcgatatctatccccgctgccgacaaacactcatccggtaagaggacatgcgtcagtacgtgccgattggggccgtgtttgggagtagatagcgaatacgcggtctcgctctctatatgcgcctccatcctgcaccggaatggcgagtcgggtcctgcggtctagatagcgtcgcgtcgccgttaatgcgaggggctatgcctttacggaccctctcgactcagcattgcttgtttttgtttctgcagagcattcgcggccaagatttcaacttgctctttgtcgacgaggcgaatttcatacgtccggatgccgtgcagacaataatagggtttctgaatcaagcgaattgcaaaataattttcgtgtcgtctacgaacagcggtaaggcgagcacgagtttcttatacggtctgaagggatcggccgacgatctcctaaacgtggtgacgtatatatgcgacgaacacatgaaacatgtgacgaattatactaacgctacgtcatgttcgtgctatgttctgaacaagcccgtgttcattacgatggatggggccatgcgtcgcacggctgaaatgtttctccccgactcttttatgaaggaaataatagggggtatcaccatggatagaaacacgtgccagggagaccggggggtttttactgcttctgctgttgagcggcttcttctatataggccgtcgactgtacggaatcaggatatcctctcgcgagacttatacgtgtatgtcgatccggcgtttactgccaacaccagagcctccggaacggggatagccgtaatcggtaggtatggagcagattacatcattttcggccttgagcactttttcttgcgggccctgacgggagagtccgcggatgccataggagagtgtgccgcgcagtgtatcgcgcaaatctgcgcgatacactgcgagcgtttcggaacgataagagtggccgtggaagggaatagcaaccaagattcagcggtagcaatagctactagaatttcgatcgacctggcctcgtacgtgcagtccggagtggcaccggcgccacacgacgtttgtttttaccacagcaagcctgccggcagcaacgtcgaatatccctttttcctcttacagcgccagaaaactgcggcgtttgatttttttatcgcccgcttcaactcgggtcgagtactagcttctcaagatttggtttctaccacgattagcctgtccaccgatccggtcgagtatttgaccaaacaattgacgaacctctcggaggtggtcaccggcgcgacaggcacaagaacgttctctggcaaaaaagggggctacgacgataccgttgtggccttggtaatggcggtatatatatctgcccacgcgtcggacgcgacgttcgctcctataagaggagtcgaggccacgtgtcgcggcccaacagaagcgtgaccggccccgaagcgtgaaatatatctgccgcgtcgcaggaaaagctaaccaataagcagactcgcataagcacaaaccgtttattagaaggctacccgatgaataaagttattttaattccagttagaaataacgggacataggtctccgacttttatactcgcgggcccgtcgaacgtgcacactttcaatagcgggcgcagcgctagcatgtcccctagatgcagagccatggtaatccacgaagacagggcttcgtaaatgggatatctgcgccacgcgtcttgcaaaggcgggggtctcggaattctgatgagctgacctactgctctcgtggccgtctggagacccaccagggcgttgacgtaaccgtcagacgctcccaaagtaagcaacgtcggtatcagagcatataggagcatgttaccttcgtcgatagcgaaaatcatgtttagcaataaggttctcactgcagactccgacgcatccagactatggagcgtcggactaatggtataggttttcccgttatatgtaatggattccgcttcacggctcgtagggggaggcgctagccctccgccgatcgctatcccttccgtggctcgagatagcgtcttagcaataatttcacgtgcgagtctcgccggaacggttgatggaaataaaagttcggtatcgatcgattccaaccggatacgggagcaaacgttagggaaaagcggaggtatcaggcatacagcatccccgttacataggtcgaacgggccggtgttttgaagtgccaggcctgaaggaatggtccccattcccaaaactacagcactcattcgaccgggtagcgcgcgggtgacgacggccgcaaatcgtcgtttgtaggtcgatagcagactcagcgtatcaggttcggccccagcgatgtagtatgacttataatctacttctttgagcagcactctggctctgacggacggtaaaaaaagaactcgcccctcacatcgttgaagtaggttcgcgtcgcacgtagaaagcccgcaggggagctcgatctctactgtcgtaccattagaagcggccataacggtaccgctggcggtttattttcggtaccgacggcggcagcggataagtgtataggaaccaggccgagccgctgtcaggtcaagcacgtagaccgcggaaggttagcgatcggcgagctggcagttcagcatgcaggcaagcatccaccgatcggcgaagcgtctttgattaagtattgagccaagtgcgtttctgggttatccgcaccccctgcgaaatacgtgcggagcaaagctttgtcggtagcgcaaagtagcggataggcttcctgaaatagggaacaaggatcttcgattaattccgtagatccgactggtcgtttgaactgtacttctccgtccgacgcgaatgctgccacggcagaaccggcttcgctgattagtttatccaagcaccggcttttgcagcacacttctgccggggtaaaaaatttataggtgggactgaagaggggagacgccccgctcaaattgtaagttccgttatagagcttgtccgcgtaagagaatttttgcgaagcccacggattgttggttgcgcggaacggataagcgggatccccctgccggtgatcgtacatgagtttctcgatatcggatacttcctcgtccgaatgtatcgccccggccgccctccctctcgggttacacggggttcgaaagtactccaggtctgcggaaacgggtgtagggatgaactcgcatatggacatttggccatgttccagcccgtcggggagcatgggcatcagtgtacctagaaaggggacagttctttgcggagctgttctctgtccgcgcgttgctgctttccgtagaaagtcatcggcttcggggtttataagggggggcgagccccgtgtcaaatgcaggctttggacagtgttccccatatccgtcgtagcgtttcgtaagagtaaaggggtacaagtggccgtataccccacgcccaaatcaacgttagctcgtggttgtgtcagagaaaactgcaccccccctgcgtgcgggcgcttcgagacagacacctgtccgagaaaaaacgattcggacgcccgttcggcaaacaggcccatatctgctaggaacctatcttgtcgtacgacggtaaatgcaattcccggatggaaccccgttctcaactgatgatacaggcctataggagtgagtttgaaatatcctgccatcagcgcgtacgacatttcgttgggcccgcatctactttcgcatatgtactgtgccacgggctggcggaacgtagaataataattggcgcccaaaaactgtggaacgggaggagctctgccgagcagcgtacgcgcgttcccggccaactccccgactgccgttagatggtcctgacaggcgaacaaagcgttaactggaacgggatagaagtacgtgccggcagcgatcgtctcatcattgcatgggtaggccatcattaaaagcccatggtgtaacgcgccatcgaacgttcgcatatgccttgtcgccgatgacgtgccgcctacatccggggtggttccgtagagaatcgccgttgtccgctccgccatattgttcaccgtttcctgcagagttagaagcgcgtccgcatccaccaatattctggcgttgtgtagcagcacgttaaacgtgttggggacaagatttctagcgttcaacgggtgcctcgggtcttctgcgcccaggggaggctcctcgtcgggttggatgtcgggaatgatcacagattgagacgtagcgtagatgttgtcgaaacggatgcccatggtgcaacactgacccctggaaaatgccgggaccatcacgtaataataaattttcgataggattgaccattcatgggtatgatgaggcgcgaacgtttgtcgatcggcgtctcctacaggcctgttatggactaaaacgttgccggtgcgttcaaaatccgcatcctgcaattccagccacggccgcacagcgtaattttcgtcgcttcccacgttcaaatacaagtttctatcgcgcacgccgtgcgcttgatacatcagggggtcacagtcccacagtagggggggtaggatcgctctatcgattaaggcgtggtttaattcctcattactctgcccggtcagtgagtctgtctgaacggtataatcctttacaatcgaccgcagcgcgcgaacgtgccgcatcagctctttgtagatattcgtacagtcctcagggagttcaccgctgcataaataggtatcgatgaatgcgaccatgtgaaagttattgacgaatgctactcgtttgcagttgtcccagtaactccgtatacattgaatgatcagtcgcatcagtataccgaaattacgttcgctgccgtgaattacggcttcgattacataaaacgcagtggggtagctaacgtctgagaacgttgcacatacggcattgattgtggaagcgctcattttgtggcgactggatgcgagctcttggccgagcgcatctctaaagtcgctactgcagagaggtagcggaatattacagttgcaaacccgccaggaggcggcgatcgacgccatcacttgcggaacgttatgcggccccgggagctctacatctcccgggaccacaaaaaagtcaaacgcgggatgcaactccatagatagatgtggatttccggccgataggaattgctcttgactcatatggcattcatctacccaccggggcgacccgcagagcacgtctccgatgttctcgaaaaaccgacggctagcttcccgtagaggcaaggccggcgggttcgtcacatacgccccgaaaacacacgttaaatcgcgtctgtcgcgacgtaaatgactaaccgtcgcttcgatatccaaaaaggatgagtggcacacggttccaatagcatccgataaacatacgctaattatctggttgtctttgttatggaaatatagctcccgtggcgggaacccgcgcacatctccttgacatccaggcccgggcgcatagtccccaatatgccgcgcataacggtccgcccgtttctgatatagtcccaaaggcatcacgaacgttaaatctatgtgtccgattaaagggtactggacttgcgttgcttgataaacgcgccgttccatggcttctagaaaaattaacttatccccaatggtcaccaattccgcaggcacttctgccgtttgggggacatcgtcgtctccccgtacgacttcatctgtacgatcgatgatgtcgttttcgtcgagattgagaatatagcgtgcgatgtcgtccatgttgcgtatggctttgcccatcactacggcggttactaggtttgttcccgatattatcatttctccatatgtaacgggcaccctagcagacgtatccgccatgtctagaattcctgatagcagtttttgcctcaccatgctcgttgttactagtacgccatctacgaggcgccctttcgaatcggaatgggtcagcctcggcattgcaattgtctgatgagtagagttaaccatcttggcgaggaatgagactatactgtctttgctcgcaccggctttgctcatgatgaaggtatcgttacacactctgcgtttgagctctgataccaaattcgctcgcattacctgcccgtttacccttccttctgtcgtgctgcgcgaaaggggtatcagtagcggagtcggcggagccttttccatcagtattctaagcatctgatcgaccgtgccccgctcaaacgaatccaatatcgttctcacgtttcgagctaattgctgtatggctctcagtctcaggtggttagatattgccgttccatctaaagatacttcagataataatgcgagtgcttccgccgcaacgacaaaggccgcgcttaacgatcgcttgcatacgcgctttaccatgtaagtgtaaagcggttgatcggcaggatggggcccctcgcgcgcaatcatgggttgctgtatttcaaattgcacggttccttcgcgcatgtatagcagatcgggagcacgcgtgcagacgcatgcgactgagagccccgtttcgagaaatctgatcaaagacaatgtattgcagtaggttccgagaagaatatcgaactgggccgaatagcgtccgttgtcatcggaactgaattgtttgaaatagtcgaacatgcatcgatgggatgtcatttctatagcagtcaggagtctacctgtaggcgctaacgttgctcctacgttgaatggtgtcgaaattgcacacggtgcgattggcggacagtcggtcgccggaggacagcggcatccggccatggtcgtcaacgggccgcgtccgatgtaaggactaattgccaccgtgactatccgatgctatgcgtgatccagggcatctagtaacgtttggtcgcgtcgaaggtcacgttaccggctgttcgaatgcgacgcaaatgatagccgatattgtaggagagacgtgacgtggagaatgcgcgagttctagcaacacgaacgaaattgcatattagactttaacgatgcaggtttttatctacacaatgaagtcgcgagtgcgcgtgcccttatatgtgcaagtttccgcccctaatcagaacggaacgcacgtctttatcagtgctcgtgtccacaaacgagggaggagaaatcccagtgcgtccgacacagctactgtagcgtaggtgatggtagctcccattaacaggtataccacagctccgtctgtcttatcgttttcctctaattgtaaaactttctccatgaatctcggatcttgaaacaccatgcggtaagaaaatactccgaatatcaccgcccccaacgtagacagaataccaacgaagatttgctggcagttatccataggcatgacatcattctttatgtttctgtacatgtaataagtttcgaggagtaaggtaccatagaacactgcggtaatggtcgcgcccaggatcagaaaacgattgtcgtgcccgtccatcgcgtacaccagaaatataatacaacacgagggtcggagaacaaatgcagatagccaagagagcacaacataccgagtaaatttggggttcatgtcacagcttttcgaaatagtgaaaattgaacctgataagtaagaggacatcgtggcatactcggccgcatcttcgcaatcgatatcgtccgaaacgcgtgtaactattgactccgtgtcttgcatattcgtctctaactgttcatcgccaatatagtcgaggagaatatcgcaatcggtcggttttgttgtatggtatccacgcctgtaccaaggcatagtgccactcgagaaggaccgtttctggccacacgtaacgactttgtcttctactaaagaccacccggactcggtacagacccaagctagagctcgagaccgcggaaaatggatatcaaatacgaacagaagatcttgtatagaaacgtccacttttatatctcggaatgcggccgcatagcttatttcttctgcggtggttgtctcatggcggtcgggcgaccgcctaccgatgactcgcaggcagagtttgcaaaatttgggctggctcttcgaggcgatggagagtctaaacccttggcagcttatgtacggcgggaattgcttcgtagaggaatgaaatgggcgctgcctcccggcgacgatgaattattcatcgactgtatggcctttttgaatctagacggggcgtgcagtgaacgtgagatttgcgatcttgtttgcctggaaacgtatgatccggagatcacaaaacacatggtatccacgaacgtcatttctggattgttgatccagacggcgcatgagtcgccgcgggactgcgtgatccacctgcccggggccccacaagttacagacgcacattccaatgctgtgtacgaatgtaattctggtgcattcgtgctaacttgcgcaactttggtggaactgcccacgtctctgaacgatctcgtcgaagggttgtttgacggtgtccccatccccagagatgcgctctcgtcgaggtcgcttagtagacgaacgaacgtgattatcacgtctaccaaagccgcggaaacgacgactatacagcggatgcatgtcccgcgacataaacagaggggcaacttaaacaccatcgcagctactttgcgaccggtgaaaaaacacgcgcggtttagcccgttcgtgcaagtaaagtatatacctcgcgtactcaaaatatggagttgtgattcagatagccattcgccgtccctaaaggagttgcgggaattgttttgtaaagtggacatggtccgtagagaaaacatgtacgcagaatcgcaattggaaccagagtccgtcacaagtgaactggttctgatagtcgatactgtatttgggagaccgctcgcaccatttattggcgtcgggtcggaaaacatacgcgtctcacatttccaaaagttcttactgctccagggcgtccttatattaaatcgtttgccgaattgctacggaccgcttcgggagctgtgcattcagcatgcacctgccggtgaagagtcgcctcctctggtatccgactctgttatcgcagacatggcgaaccatatgtttagggtcgccgtatttattggcatggttgtggaaatagttgcgggatgtgtatcttttgcatcagaagaactcgaaacgcgatttcccagtgcgaccgcgtttacggatgctggcattctactgaacggcatagaagcctcgccgaagccaaattgcttgtcggaacttaaaacacgcaaactcgctcttatcctggacggtatttatagagacatggatcctatagacgttgctctacaggaatcggtggggctaaatacagcagagttattatccgcagcaatagatatctcggttatgtctgcatttgagcattcgggatggtgtagcggctacatggaacactttgtttcattgctagatgcccgtctgagagagggagggtgcttggcaatattccggtagctttgtagcacagcggcgagacgcgcataggcgtgccgggcatatacagaacgtaagccaagctggagtttgtgtaagtatgtgctctacagcgtgcgggaagggcggttcgcgaataaacacaacagtacaggttcgacggttagaaagtttccagagtttattaattagattggcccctcaagatcgtctttgcgtcttaatttctcatatccatggtacctaaagttgctgacaagcattttggcggtgacaatcgctatagctgcggctattagtacacccgctgcagtagttgcgatgtaggtcgccgagaggatggcaatgcgctgcgactcaaacgctaggatcctcacgactgtgccatttggatacagcaatagtgacgtgccatacaggttactggtggtggggttgaaatagcgcacggacgaattgcctgctgctagcaattcccgctgcaaatcgcgcgatgagatataaatcgcatgtcgaacgtggccgcttgcggaatatcgcagcagcacgcagccgcaatacggacattcttttcccagaggcctaggtaaaaccgcaggactgattatacctgatgtcgacgtgcacggcagcctggcatatgttatgtaaagttggttgtttacatcaacgccgtctacggtatacacgatccctctgaccccggcccgccttgttacaatgtagctacctataccggagatgggtaacaccagaagagtgtcggattctaacctatcagtgcccgaacattccaaaacctccgacgcgtatgtagcaactgttctccctattgatgttcgcagctttgcaattactgattccgccttggcctgcagatcttcttcgattctgaccccctgagaagtattctctaaatactcctctattactggacggtaaaccacattggccatcgcgtataccctgtgacgccgctcggaaatgtcgatcctcaatgatgtcatgcacggcgtatacgcgtccaaaatatgtacgggctcagtgctgcgagtgagtctgatatacatgtcttgcaccgttaattcagcggccgcgatgtgttcttcagtacacatcgatgatgcaaataacagagatttgcgtgcgttatgcgatgcgcgccattccatcggcgaccgctgaaaaacgctgtcgaatgcataatacagggcgtgtctcgtggaagcattccacgagatcgcgtccctgacggattcttcgtggagagacgtgataaaatttagtgcgaggtcggaaattcgcgccccccattcgcccttctcccgaggtatgtcgaacgcgtacacggaccggaataggtacaactgtcgcgcaatacctaaagaatgcgtccccctcgatacatcgctaattttttttttcaatacggatgttagtatagcagctttttcattccatacatgtgtccgcgataataagaagcacgtgccggggtccgtgctcggggcaaaattgcaaagtgccgcggcgattactttcagatctgcctcccttttaattaattcatcgagggagacgtagccagacttaaaagcggcgtgtacggacgcaacaagcgccagaaacaaacgcgtcgttacgatcctaaagccgtggatataattactagtagatgcgggcatagaggcagaaataaaaagccgggagtgcgcttgagtgatatgaagattataatctaataggtcatctacactcgaaaccatatctgcgtgggcctttaattccatatccgaggcgttctgatatgttcccagtaggtatgtcgaaaggagatgtcgagaggatccgttcatcgggtcatactgcttcatcggtggccacagcaaagtcatgttggtagtccccgacgataatattagttccacaggcgatgcggcttccatagagatcgtaacggaggcgaattgcactcctaccttcattaagacctccgcggtatttgaaccgaatatcgtcgtccgcacgtgggcataatctgtcgggactagtgtgtccatggggtccacgaagcatgcacgctttgcaaaagctcccgataattcgctgttgagaataaaacggttctccggagtgaagaagtcattcggctttatattttctaacactgttggcgggtttgcgccagtaggttgtgacttggcaccaccgtgagcttttggaccgggtttgtccggtgtctttttttcgtctcgtcgatgggataatacggctgccgtcaacgagtaatcgaggtccggcttcgcgttcaaaactttgatcaggttattagacgttagcagcctagatatcggtcgtttgaagaaaaccatttgcttcacttcacttattggtaaatgaaagagaatgccgctcgccggcgtagatgctcctatatatacaaatgtcgcattgtcgcgtacccaggacgtcgggctagtagcattttcatcggccgatgaaaagtccaattttacggacggcggtctccggatgtctagcagcgaccatacggaggggatattatccgaggtgggggctcccggggaagatgcgagcgctagcagtaataaggtgcataccgccattccgattacgcggcgtcggtcgttgcctctgcgtatcgctagttcgagctcgggtttccgaagcaacgtaacacacatatcctatagtgtacaatgtttcgatgcaactgaaagcaacgagctaaagcgaagatgttttgcaggcgacaagggcatgcattaatgcacactcgtccgaaatgtcgtagtctcaaatgtccatctccttattgaatgcctgaacgtccgcctcgatctcaaatacatcattccagctcatatgcgttattaatctttccgccattgaatccataagatactctgcacatttctggaccgacatgtcgctgacatcaagccgctcgacattgatgttcctcagtttcatcaacatcccccacaatatccacccgtataccgttaacaggctaccatcttcactgcataattctttccgcttaaaaattggcaaaagcgtgtgctgcaatgacacccggctaccatggtaacctgaacggggaccatctataaatgtagaggccatcgatgcatcaaaccacgggagctgcatccactctgtttcccattcgtctttactgtaaggacaaatgcaattcgcatacgcgacggtatctgctaaagccgaatatgccgcattgagcgccctgagcatgcgcacgtctgtagtttcccccgctctgttcctggccgataggcgcttcaggtgctcggtttcgtcgggcaaatgtgctattaccaagttgcagccgggcggttcgtggggcaaccgtgtaatcgcactaatcaacatttccagagaacaatcgccaatcagatgtcgggcgatgggaaagcagacggtagctgaaacaggatggcgatcaactattaatataagagatgggttgccccgtgttccggctaattgatgacatttagatgatattcgttcgtgtagtacaatgaagggatcggcaaatttggcctgcaaagccattacgatcatgctagactgaaatagagataattctccccgacgccggcgttcggaagcgtcattcacagctgcaactaaatcggtaaaatagcgacgccaatatttcagaggctcaaaaactttcagcacgggtactcccgtcgcagagtggctcggcacttcgtttaacatcgacgttttacctatagccaatggcccgtcgaggtagacgcggatcagctgcgcggatgtcatctgagagggcattaccgaccacggccgcacgtccgacatgtccggcgcgcaagaaaactgctcgtagacgatataaccggcggagaagcacttctggacgctcaagttaccgtgcggctgttaacctcaagagaactctagcggccggcgttcgatgtcacgcacgtttttaccaaaagctctacgcagaatctatgcaccttcgaactcaggccgatgattggacggggcgggccctatctaagattttaggaaaaattatggggtttgatgtatttaaagcggcaactgatttccgattggtctttgaagtaaatctggggcggcgaaaaccggactgcatttgcatgattaggtgcccccgcggtctatgggaggcaagttgtgatggcgcttgcgtcatcattgagttgaagacttgtaggttctccaataatctaggaacggccagcaaaaaggaacagcgcctcactggaacaaaacagctcttggattcaaaattgctgattgactatttagcgcccgtaggttcggagcgtattttcatctgcccgttactagtattcgtgtccaggagaaaattaaacgtgttgcgtgtaacctgcctcagaagaaacgtcgtaagtaccgatttccatcgtctcgcaactttaataacgcttgcatcggaatataagattaaacaggtcgacaggcgcagaacggctgttcggaaaccggctcagtgtgcaagaaatttcgcaagtcttgagaacgcgcggcgagacgatcgatcggaagaggtcgagatacacacttttcctaactgtagtattgtcctaccacctcgtaccattctacccggagccgcgaatacgacaatgcaccgtttggcaagtattgttagctgcttggtacggaagcagtaaccgaaatcaacggcaccctacgaccagctatgttacacggtgcaatccgcggcccttctcccgttactttcttgctccgcagcccttgtccaacgtcagttgtccgtaggcactgcagcaaagcatggcgagctttgcctgggatgcaagaattttgacagacccgggcccggaatctcacccggctgatgtaaagaatttcatagcacctccctggcctctgcacttctggagggaacctatatttagcggcaatcttggggatgcggaacggcaactggcaatcgttaaggcgcgaaacagtgccgcgattgcagcgttaactagtttggacgaccgtactgatttaattgcggtagaagtggagcgtcggcttcgaccactagaagataaaatggaacagatcgcaacgactttggcggatttggaacgagctgcttctgcggctgaacttgccgacgccgcagccgatgaggctcaaaatgtcgtcgattcgaacgaatgccaaaaaaacattggtagcgctgcgagtcgcgaggtccaaatagtcaggaacgatccgtcgctaagatacgactctaacctgtcggtggatctgctgaatattatctatgccagcaggggcgctgcgaattcgggagtggcgttcggtacatggtaccgtactttacaaaactcccttattgcggaaaatcccagcgctgcgcggaagatagattatcgcgatggaagaatgtcgcggaccttcattgcaacggcgataacgtccttacagtcatgtgggcgcttatatgtggggacgcgtaactattcttctttagaatctgcagttctatgtctgtatgcgttttatacaaaaacgggagctaatgtgtcccatccaagttcttttaagagtgcattagaatctgttcccatttatctggatcacatgtcagcgagcctcgctagcactgataccaggcaaatctacgggttcgataccgggaaattgccgaaggatagtttcgccgccccgtccggaaaatacgaacggggcgcgctaagtgatcatagcgtattgagagctctagcaaattctcgcgtgttgcctcctagtgcggggtcgatcccccgtggagacgtagccccagagctagatgccgaccagagcgttcgtaacgacgaagtcaacgctgccgccgcagcgctactgggacgagcccaacccctcttccttatggaggatcagacgttgctgagagccactttggacacaatcgtggcattgcttttacttcgccgtctactttggaatacgaatatatattcagctagagttaaaaaccagttccaactgggggcgttcgttccaggcgtgcctccagatttaaccgtaggagcctcagtagacacgccgggggatgtaattaagagtgacgggagaaacttaacctttttatttcagagatacgtagttcccgtatatagtgttgtcaaagggatagagctcacacaactctttccggggctggtagcgttgtgtttggacgtcccgttttccgatcgagggttatatagcaccaggacgccgccatcgcgtatcattgacgtttcgctgagtaaatatcaggcctccctcgtgaaattgatttccttagagcttcaaaatcgttcccgcgctaatgttgtatctgtttgcgaggtgatcgcgactcacgatttggtgactctgcagtatgagcgaggcttggaatcgctgatgcaagtccagcgtccccgcacccgcttttttgaaaccaagaaggctttggcgttcaatgtggaaacggattacgatctgctttatttcgtgtgtttagggtatattccgaggtccgtatctgcatcgtgaaatatacgcaaaatattggcacgtgtccagcttaaacaacagtttagtagaaatgaatccgacggagaaatattcctcggtatatgtcgccggatatttgtttttgtacggtgcagatgatggcagcgaactgcacatcgaccgcgaggatattcgagctgcaattccgacacctgctcctttgcccataaacatagatcatatacggaactgtaccgtcggagccgttctggcactaacggacgacgaacacgggctgttctttttaggaaaaataaattgcccggtgatgatacgcacgctcgagacggccgctagtcaggaaatattcagcgaattcgataatctcaaaacagaggagagggtattgtatttgataacgaactatctaccatcggtgtcgttatcttccaaacgtcttgaacccggggaaaaggccgacaaaagttttctggcacacgtagctttgtgtttattggggaaacgaatcgggactatcgttacatacgatcttactccggaaaatgccattgaaccgttcaggaagctttcccctactaccaagacggccctactatccgaggggcaagaaacagagcggctcttaggcgataaggtctggcatcctagtaaagaggcgatgtcaaccgcgttgttgggcaccgctctgaacaatatgttattaagagatagatggcgcactatttccagccgaagacgcatggctggtatatccggccagaagtacttgcaggcgtcagccttgaccgcactggccgagtcgatgacgtccaataacgcatcaacgatccatccaatcggcgaaaccgcaaactcggacggcatacaaaaggatgatcgaattgaagtgtgcgccacttcgccgcaaacgaacaaaaccttagagtccagagcattttcgggagggagtgggttcgccgggactcatgcgatctctccaccgccccagatgagcgcacaatcgccaaccgagatgtctatgaatactaaatctcatttcccccccggcgacgatttcatttgggttcctatgaaaagctacaacgaactggtgtcgagacaggccacgcacgcaattaatgcccccgaagctgcagtggggagccaggcaccgtatagttcctctccgttaatgattccggcgcacttgggacagcatgctcacattgggggatatggacatgcctccaacccgcaatttgcatcgggggccataaattacatgggcgggtttccatatgctctgcctatccaccccgttccaaccggccaatcgtctttggaaaccaagctgtcggctctactggattgtatgacgagggagaaaaaatcagtcgatggggatcgcggacgtgacgacatgttctctggccaagaagaacgaggccggcgcgggcgcaagcgcccgtacaactgtgacaaatctcccgagcaggaaccttattatccaggcgaattccagcagtccgagcatcgtaacttaagatgcgaagacggcatcgaatacgggcgagacgcgactcaaacgaggcccgccctggcgggcctcgtgaacgctgttacgtctttgcagaaagaagttgaacggttaaacggaagggcgcaagcccattcgataccggccgtacagcatatgcaaggaatgggaaccggattccaggcccccgtatactacgcataccctcctctcccaataccacatgtattttcgcggccgccagaagacggccgcccaatttcttccggggagggaagggcctcgctaggtagcgccacgggcactcctccgtctggatcggtacctccgaacgcttctcaagaacgtgtcgatgcagctcctaaaagcgacaccgttcagtcgcaagatactgtgaacgccagtacgatcgccaatgtacatcgcgccgacgatgcaggcgcggatattttcattaaacaaatgatggcttaaatgatggcaggggatccgctatgtcgacgtataagtttatacattttgcgaccgcaatagcaaataaaagtaaaataatcgtatgcgcacgtgagaatttatttatcgagaaacagcatcgcgctaaacggcatcgtcctccgaatcagagtacacaggcgataatctatcgtagtgctggccactactttttagcctcagctttgttaggtgattagaaagaatagcagtggtgcctcttgtttttttgcgcaaatcattttcgtggcgttcctctgcggacaccaacgccatatattttatcatttctcgagccttctgtaatttttttttatcgattggtgccttttccgagtccggttcttctccgtgcaactcgcgcgttgcctgggactttagctcttccgtcgtcactggatatagggctttcatcgggttgcctctaagcttgtttacgtaccagtaagctagaaacgcagccacgagtcctgctataattatcaatcctaccgctaaagctccgaacgggttagacataaaagcggacactccagatacggtagccaccacggcaccggcggcacccacaacgaccttccctatggcctgaccgacttgccccataccgttgaacaattccgccaggccgttcataaaagcgtaatttgtatctacttctattactttatttatgtcataaaattttagttcgtgcaactggttgcggcgagccacctcggcatagtccaataccccgacatctcgcaactcctctttcgtgtagaccgacagaggaagaatttctctgtcttctaacagtgttaagttcaggtctacaaacgtgctggctgtctgtatatcagcaacctctaccatcttaacaaagttatagtcttcgaacagagcgtatgcggatccaaacaggaagtatctccgctggttagccgtacacggttctacggcctccagtgttgggagtagctcgttattttcgccgagctggccttgtatcctcccctggttctcgccatacgaaaacaagaccagcgggcggctgtagcacatattagtagacgtggcgaccctcatggaattctgcaatgttaccgattccgcgtcgatcccagtacaagtagacacggcggtcacatcccctaacattttagccgctacgcgtctccctaaggtagcgctcgcgatggcgctcgggttaattttcatcccttcctgccataaagccagttctttattttgtaattcgcaccaggccgtggcgattcggctgaacatgtcgttgatatgagtctgtatatggtcgtagagaaattggagcatggcgaattggacggacgaagtagatcttatcgtagcgccttcgttcagcgccagtttttccttcggcgcattacggagctctcgccgcaaacgggacaaggagacatttgttttattggaaagagcatgcttattatgtactaggtctagcagctcgtctgtcctgttgtccctcatcagttctcttagatacatgtgagccagagatttcgacataacgggctgatacgccacaagaaatccaccgagggccaaaaaatattggaccttcccgaccttgacgtggctgtcgttatatttttgcgcgaatatgcgcttgattgttgtttcagcgtcgcgctttacgcactgacctagcctgatacgatccggatcgaattcagtggtattgctgataaatgttgacgatagctcgcgggccatgaatctatacttgccgttaaccgttgcgcgcaacatttcagtaacatctttccatttaaccatcgagcatacacgagcggtctttgctgcccagtcccacccaaccgtaaaatgtggagtgacgaggaagttacgcttgacgggtatgctcgccttctgacgcttgctcagatccattgggaaatagccgtctatctgcctaaattgttctagcggatagcccatgggttcggcggcggcctcgggcggggcgacgccataaaacggggacatatttgcgatatctccgttcgccattgcaaaatacgagtatgggaatgcagccctggcatccatttcttccactatgcagttgacagacgtccccgtccgatatacccacggagacccccatacggtataagtgtcgttggtcgtatgccacgccttggactcgggggtgttgaattttgacggttgtagaagtacctgtttttctccggcgtcgccgtcgtatgcctcgacgtatacattgtttctcaggtatcgcgctttggaggaacatctccctttcgcgtcgattacatccgtaatttcttcgatggaaacgggagtcctatctgtaaacctgttggtgatttgtctgtacgtcgtcccggtccaggtcgtcgtttgtataacgttcttataataaagcgtgactttgaatttgtatgggtttatattctctttgaagagtatagcaattccttctccccattcggtggcctttagcggttcggggcattttcgcggcggttctaaccggaccacggtcgtaccgaccgccggtgggcagagaaaaaatgaggactcgtcttcagacagctgtacgctcgagactgcttcccgcgacgttacgttttgggccctcgcgactcggccgaagaagtagaaaaccacagatatgaaaagtggaacgcagatcccactgaaatggttcattacgggttgatcttaacgagtctcatcgatagtgtggaaaggcgcgccgcggtacgaaagatatcgcactggtcaagtgggggtgtggtcatggtttgttcgttccgcacgtatctgatccgcagccgcgggagccatgtactgcagaatggaatagagcagcgagaaaacatccgcatcaaggattacggtcacgttgtctgattccgcaccgaggaccgttatgagagggcattctgtttcatatgtgacgtatattccatcctcccatatgtattccacgttaacattgagcggcaagcaatctgcacgacgcaggtgcaattcaccgcagctgaacgcggaagaaaataaagttgtcgccaaaatcacctcttttatatatttccaagccattctatgggccgcggttatactatctatgccgtcgaagtcgtaaaaccctctgaatttactgacgatccagtcagacgaactgcaactatgaatcataaatcgcgctatttcctccttcaaatgcggcaatagaccaacgttctctacactgaaatatagcgctgtattcgaaggttgggcgaacctatgtacatcgtgattaaacatcgggccgtttaacaaccgaaaaaatttgtgagttaggctggggagcatcgcgggatctattctgtgcttaagtaatgacgtttgcatgaaacggtgggcgtcgaacgcatcagcggtgatgcgattatcgatgatattcgtacatcgtttcctaatggcttccaataacctattcctggagcggaacccattgaataatgtcgtgtatgagtctatcaatatttcaccgtatacgttaacccgcagcattttttccagctcctttctttgctctgtaatacatttatccaaacttgcgagggatcttttacttaggcgctctgcgtacattttgcgtctccgagcaacgtcagccgatgccgatcgtaccaactctaaccagtcgtagtgctcgcggacatcgggtaacggggtaaccccttcgcgaatccgtagatgctcggagttactaaaatcgtcctcgggcgcgccgtcgccgtcctggcataggggaccatttctcgtgctatgcgaagtcacttgttctaaagtagtcttcagcgcgtcttgcgccgcctcctccgggtacaataaacgttttagcagaggagtcgacatatgatgatcgtaacatgctcttatcagcgcttctatgatgtcgtctggcgctaccgccctaccccccagaagcaatctgtcggccgcattcatattctcgatttcttgtgcaaacacccgttcgaaatgatccatgcgccgcccgaataccgtcatttccacgacggatgttctcagatcgaaaagacgctctttgaatgctaaatcttcgaggttgtccgcaaacgagtcaatcgtgtttgctctcggttggttaggtttgcgttcggacgaggcaatccagaattgcagctcgctaatggcatacagattccccgatgccggcaaaaaaacgttatgcgcgtccaggacggcggttgccgcatcggcgacagacactgtatcgccgctacctccgggatccttgtctccccttgtcggtctaatgagcgaaagtgccgcttgtacaaccgaacgcttttcgtcggacagacaagcggcatgtgggatgtgcgctaccatgtcatctgggtggacgcggagaacgatctgcttagttacatgattacatatttttccgattatgcgcttatgtgccgagtctccactgtttgccgtcacgcatagttcttcaaaacaaacggagcatggttgtgacgggtcgcacaactccggcgaaacgaccgatcccgcgcccagagtttcgattagatatcgatccagggccaacataaagttttctgcggttcccgcttttacgattaggtgacagtaattgagttgcttcaatatgttttctacgtcgtgtaggaatttaatctcggtccgcaccgaaccgccgtaagtatccaattcgacgacttcgtgatacggacagtccccggatatggtcatcgacttaataaaaaagccgtgtacatctccggtgtctgtaaactcgcacagcgcacgcagcagcacttctccgtctagtcgagctctacgcagagctaaccacaaaccgtagctaaggggactaatattcctctcgagttgctccgtcagcccaggagccattaggttttccaaatagcgtaccatgagcacatttaatttcagcggcttgatcattcgcacacctactctcggatcgcatctcttcagcagctctacttgaaacaagtacgattgcaactgaccccatacagcgagcagtttctgactagcgaatatactgtctcgctcaacgtctagcgcttgtgcgtttccgtgaggcatatccaacgtctcggttcgcctcgtctacgctgaattggacctgagtcggagggagagcatgatgatatttataggggttagccgataacgccccatccggaataagacccacaaagcgatataagaaagagtatgctgtatatttcatatttccgtatacaggttgaaaagccgacaatgacgtagtatctatcttgataaggctatgcgagcaggccccatccgggatatgagctaggtagttcgatacaaaagtaaacgcgtttagacccaaacacagattttaaaagcccgcaacccacgtactgggacaacaatacacgcggttatagcatatccaccgatagtcctggagcccgcttttcgggaacgggctccaagtcaaaaacgtccgaacacggacgtttcaaagttggctctaatatggacgggccgtccgcgcgtctttccgtattctcatcaagagcatcgtaattaaacgtaggtccgtccagcgggagagccttcgacatatcgaccatctctttcgctaatatcgcggcagcatcgacactccaaccgccctcgcatccctctacctgcttgttaagttcatctatcaaagatgagatgtacgcatcgttagttatttccatccagtcatccagttccatttgccgtacacgatctccaaccattttcaacgcgatcatatatacggcggcatgaggcgctccgcactcctcagataaaaccgcccgggctctatccacgagcgtggtttccttcaagcccgaggaaaatccagtctgttccgatacaaagccgaccctaggacatgccatgacgaaacggtgggttctattaaaagacattatggagcagacgtttctcccacccattatgttgccccagttgccggattggaatacttttgtgctaccggccattccgtgatatttactgatgctgacggctatcacaacaaagggtttagaggccatgataggaccgacgagattagtagatgaaaaggcagcacaccatgcttccttatgatcacagatattttttagcagttgctgggcggctggtgccacatctgacccttgtgtgaggatatgttcgatccagggcaggaccatagccggatccctaggtcgcttggaggttgcaaccaaagccgaaatcgtgttgataaagaaatgcttatgtgaacagtacctcaggatggtattcgctagataaaattgagccagctccccgaagcatgtaggactgatgttaatgtaattcatatcggcgtagctattggtaaaccttttaatgaatgacgtgttctcctcggcatctttggagagtataccggccggcaactgattgcgttgtaagaggatccaaaaccagagagcattgggagtcgtgccattaggcatcttaacattcggaaaaagttgcgtgtgataccgtttgagcgcaaagccgagagggccattgagcacatgcatcgcttttgccggccgttgatacgcttctatcatgcccgccagccgggattttgtagcgtcggagacggtactggaaacgcctccgacgaacataactttattcttcactttaaattcccggaatatctcaaatgtaactttcactagatctccttccatgtgcaccgccagcggatcatgctgagatttgctaggatcgggaacggagatttgttgatcctctaaggtcaccgttatgtttttagatgtgatgaacccggcgttttgcaagtccagtacgcgccgcctgagtaccgcttggaactgagtcctaaaatttctagcctctacttgttgcccgtgcattatcatagagcactggcttaacgccatatcttgaacgacggcaattatcgtgcgcctggataaaaatgagagcacgggacatatgcctgacgaatacggctctattgccagcgaaagggtatgggttgcatcacctagcccttcgcgtatgttatattctctgatttctgtcaaatttcgcatcagctggccagcttcgctctcgattatattagccattgtcgatagagcacgcataaacgatttgccatcccggatgatggcatctgcgggtgtcatgtctgctgggtcctcgcatgtcagcaaaccttctttttctaacgctttcattactctttcgaccgtcagcttgtacgtgtcctgcattacactgcggctcgtctctccctccgatcgtttgagagtcgagaatggggcgtagcttcccagcgcgttcacgtcgcagtagttattcgtcatagatccaaagagccccatagccccacgcatctgatacccgaatttcggcaatcgatattctaagcgcttaattgtggtatgggcgcaataaatacgcgacgctttgtcgcacaaatcgcatggtacgtccgcgtccatggcagatgaaacaaatttcacggtatctaaatcgtgatggcaagcttgagatccgccgtcacacctctccaggtagaacaagaatcttgccagcaattgcggacaaaacccacacgccaaaattaggtaatctaacgagtattccgacgggctggccgatgtggctttggacaaatcttcgcccggaatcggcttgccgtctctatcgattaacgggtttgaggccaaatgcggcgcggctatttggaaaaaccgataaaacgaggctgcggtcgtacttgtgtcttttccgtctgcgctactcgcttctcccacctcggtcatgtatataaccgaattcgaactaaacaccattgccccgaccagtcctgccacgcgggccatatacgcagacagcgcttccactctatctgtatatccgatcggactgcaatagaggggccatttctttacatcgggtatagactcctcgtagaccgatgtcgcgattacgttttctatggacagagtagcgtcggatgccattagagaagccgtcctacgttcataccccccgccagatagctccatgccttcctttttccccgctttatactgcgatttcgaagcagattcgatgggagtgaatgcgttaaaagctgtatctgcgggtaacaatgttccctcgtgattttcgtcaaagcttaaatgggcggcacagcgcgcaatcgcgtctacattgcgaacgcgaaggcctacggccgcggtactgagcacataaccgtgtaatagacgacataaggaatcattatagaaagcctttggcataagagctccctcgcctagtgctctaggcttcgtactaaatggatcgctggcaacgcggttgaagtccgggaaaaccaagtgcaggggatataacggtattctacgaacatcgacgccattaatgctcacgactccagtaccaccgtaatgtaaatatgagttgcagaggtacacggcctctttaaataattcggtcactactaagtagagcatagtttcttgaggattcattccgagattatcgcatatttgctcgccggttgtttcgaacgacgtggctaccgggggcgaataggtgctgtagccgaatcttcctcgtgccaaatcacatgctttagtcagattcggagccttcgtgcacggttttatacattctccgccgtgaaacacaaacacgcacggatggtaatgcgtcggaacgagcttgagagtagttgatccgctacccagacccgttgtcttcgttcctgcaacagctgccacgttccacatgaaatccgcttcaactgtaagacctgaaacgagaggcaatatcgcatcctcgcagtcattgctcttggccgcgaagatcgagagatcttcagctggcatgctgctcgtgggtgcagcatatacatatcctatcggccccccggtgatcttaacgcttttccctacatccatggttaaggtgtcagcgtttatccggtagactgtacaacggaatggcaaggggcgatgtgccttccaaagctgcgaacgccggcttcgccaggagatggcactttgactttctcgtgccggatgttttaaagccagaggacctccaaaggatatgacgcaacacttcctaaagtgcgccacgaaacacgtcgcgcatattgtatgttttataagtcctcgacttcaaacttgccttctctgtaagccgatatgtcagtagatggggctagaacttttttcaacccgtacctcggtgcacgaaagaggggacgggatgaagatagtaccataccgccgctaagtagaccgcgggacggggagagataccttcggcaacatcgcaatgcgattacctatatagcgactatagacgaatttaaatatatcgcccccaaatgcttagacgcggcggaaataaagcagcggggcactcatatcggcaaattgaaacgctcgcctatactgtacaaaaacggagaggaacgtgagttcttgaatttcgaggctttgggggacgcgtggccacggagatgttttagctggaataacgtatcattcttacccacggaattcgacccgcgtttttctaggtttcatgtgtacgatatgattgaaacggtagagtttgcaaatggggcaacaggcagagataaaaaccgttttctggagctattgcggcctatgggcacgattattaccatgatgggaatgactgaatgcggcaggcgcgtggctgtgcatgtctacggcgtcaaaccatacttctatatgcgtaagatcgatgtagacaccgcctgcgggagtcgatccacccgcggactcgctgagcagatggcgagcgtggtacgctcgtctgtgaacgaaagcgcaagaaaacgattttacggctcaagcactgtgacggccgactgtttcgaagtggacgtggtacgtcgtaaggatatttatttctacgggacagattgcgaagagtattaccggattaggtgtcagagcggcaaattcgttgcgctcatatgtgataactttcacccctccataattaaatacgaaggcagtgtcgatacaattactcgaatggtgctggacaacgccggatttagtacatttggatggtattccctaaaaattgggaattgcggtgagaaagtacaagttcgagcgccccagcaccatgttacttcatgcgacatcgaaattaattgtacggtggacaatttgattggtcatccagaggacgatcactggcccgattacaagctcctatgctttgatatcgaatgcaaatccgggggagcgaacgaatgcgcatttccggtggccacgaacgaggaggatgtagtcattcagatctcgtgtctgatgtattcggttcgacaaaagcaattagaacatgcgctgttgtttgccctcggttcatgtgatcttcccgaaaccttccaagagacgtttcgtgatacctatggcgttttgcccgaagtcctcgaattcgacagtgaattcgaactgctgttggcgttcatgacttttgtcaagcagtacgccccggaattcgtaacggggtataatatagtcaatttcgattgggcgttcatagtgaataagttgaccaccgtttacggtattagattggacggatacggggttattaaccaaagagggacgttcaaagtatgggatgccggggcaaacgcatttcaaaaaaaagggaaatttaaggccaccggaataatcgctttagatatgtattgcatagccaccgagaagttgaagctgcaaagttacaagttagacgtggtggcggaagccgcgttgggggagcggaaaaaggagctgtcgtataaagaaataccaacgcactttgcggcaggtcccagccaacgtggaattataggagaatactgttttcaggattcgttgttggtagggaaattatttttcaaatacgttcctcatttggaactgtcagcgatagcaaaattagccgggatattgctatcgcgagcggtattcgatggccagcaaatacgcgtgtacacgtgcttactacggttggcgggctcgcgaaatttcattctgccgaataagccgcaggtgcgtgcgggaaccgagttcgaaaacagcatcgccagtacggatgaatttgaaggcgaaccttccccttcgaatccaaaggcatcctcatcatttcatggaaatggcggcagagtcgtcggttaccaaggagcgaaagtgttagatcccatttcgggattccacgtcgaccccgtggtagtctttgattttgccagcttgtatcctagcataattcaggcacataacctgtgtttcaccaccctaataaacgacgacagaaaactcgccgatctacgtccacgcgatgattatatggaaatcgacgtacaaggaaaatcgctgcattttgccaaaccccatattcgagaaagtttactgggtatcctattaaaggactggttggccatgagaaaagcgatccgagctaaaatccccgctagctctgatgatacagctgttcttttggataagcagcaggcagccatcaaagtggtctgcaattccgtgtacgggttttgcggtgtggcaaacgggctattaccttgcattgatgtggccgcgaccgtgaccacaattggtcgtgacatgttgcttacagtacgtgactacgttaaggttaagtggggaaccagagatgccctcctccgcgaatttcccgcgctgacgaattatatgttgggcgacgattactccgtgagcgtgatttacggtgataccgattcggtgttcattaagttcaaaggggtagcgatacagggcctcgtcgcaaatggagacgatatggcaaaacgcatatcgtccgatttatttcccaaacctatcaagttggagtgtgaaaagacattcgacaagctgttgcttataacgaaaaagaaatacatggggacgattcacggtgggaggatgttaatgaagggagtggacattgttcgaaagaataattgccgcttcattaacacatacgcaaaaaagttaagtgatttgctatttcaggacgatgcggtggcaaaagcagccgccctcgtcgcggaaaggccttcgtcattttgggcaacggctcccctaccagaaggcttgaagcccttcggggacatattggctgaggcatacggtcaaatgacggcaagcacgttgtccgacgtgggagatttcgtcatgtcggccgaactaagtcggccaccgcaggcctacgctaacaaaagaatagctcatctcaccgtgtatcacaaattggccatgcggtccgaacagttgcccatggtaaaagaccggatttcctatgtcatagctgccgcaacgccggaggtactgcgcgatgccgagcgggtagcagaagccagaggggaaaggaaattccgctttagcgaggtctctgtcccggaggttccagggacgtttagcaacagcgccaagacgcgggccgtccaaaaacccaaggtattgatctctgacatggcggaagacccgacatatctaatcgaaaacaatattcccctcaacacagattattatctatcacatctattaggaactctatgtgtaattttcaaggctttattcggcaatgacaccaaaacaacggatactgtattaaagcgatttattcccgaaacttatacagaggatcgcgcctacgcgacgcgagttgcgcgcgccgtctttgcggagatacgcagcggggccggtctaagttctagcgaggaggaagaaactcttcaaagactgaatagagctttccgtattctaacagaagttcgccgtcgatattaatgtcgcatagcttacagtacacgtcgtcggcgttgacggctgggacatcactcgaatctgtttgacgatcgtattcttttctaatgactaataaaaagttaccgcgccacacgtgagcgattatgctgtaattcttacaggccgtttttaaacaatcaatcaatttgtagtggaggtggagagctttcccggggaacacgacatacatcatgtattcaagggagcctgcttcctgatccaagtaaaacaacaccttcacatttttcattccagaatcgagtagcacatagtatgcgaaaaaaagttccgggattgccaaaatacgagaaagggcaatttcgctatctttcccccgctcctctccgcaccccattctgccgcccaaggccacgatagaagccatgaaattcctataatgataaatgttgtttatctgttggacatatgccaatatcaaagaggcacgatcgtttcgccccaatcgcgggtctccgctagccgtgcacgtagggcaacagccaccaactccgagataataccccattcccgacaaagacaaacagttatctgcgacagcttccgacatattgaacggcaacgagactggcgttgtcttgatgatcggcacagccaaatccttgactaccattagttcctccgatggggactcttcaacgaaatcgaagtaagcgcgatacaaatcgacatctggttttcgagacccgcgtttcgtaccgcatgccggcgcttgtagatctcgccattgccgccgcgaccgtcttgctatccctccgctacgccctacagatctgcgtcgtatgaaaatgcaaccggtcatgccgggaattacgatgtcacacgtaggtttgtagcgtgtgctcgagagatatcagggatatagagtgtctttgaagaaatgcgccagcgtctttgacgaacgcggataaagtagtcggccggggagggaaaacctgatatgtcttgaacgtgtacgccaaggcccaaaacccggcgcatacgcgaccttcgaaacggttatggcttgcgagccgagctttatggagtgccaattcttcccggctcgctaggtccgggtggtcgaacaatgaccgtggattggtctgcgctatccgcgcagcacacatcgggtcgcaaaagaagtgtttgtagattgcttccgttcccgtgcctttgagcagcgccacgaagtatccgtcatcttcaaaatcggcatttctctcctgcgtcccccacgcctccaacaccggttctatgctatggaaaatgccgatgttgttagctgaataggcaatgatatcgcgcttaaattgccgcattgcaagccagtacgtgcggattagtaggaagttgcacaataagcattccgcggacgttccccctttggttatcgcgtgctttaattgtgttaccattaagggtcctaactccaaatcaggttctgagtcatcttcgtaacagtgactatatgcccgagtcgcccctctagcaagatctattctgttgtctttccaaaacttgctgaccgtctccttcctaaatttcgctgccataagagcgagttcgctcgccccatctggtgcagatcccgtgcccgaaagcaataataggacgagattcgtataacccatagtagagtcctcgccgctcgaccgttccgtatactgagaccgattagtgcacggtgctagtgcaccaagatcgttctccccgtcaggcagtgctttgctcaaacgaagctgcaattcgcgctcgtaaatatcgtcgtccgacaatgcgcgtataatgcaactttccgtttgagaaaaattacattctacgcttctcgcgcagtccttccagcctgccaaagcgacggaaagcgaggtgggaattgagccgaccgtttgacccgtttgtgggactttccttttactttcgtgtccagctgccgtgtcgcattggccctcgtacgacgagtgacccatgtcggacaccgtcgtcaacatggcccgcgtagcgctttgggccaaatacgaatagttactgtacaacactttagcgtcacccgcgcacagcgaccgtcctcttttccccgccgaacggccttgatttgcacggggcacgataacctcgttatgccgtcttcccggtacccccccgtcagttcgaaaacaaccatgcagaaagaagtgtctctggatatcctcaaaagttaaatgctttctcccaaacgagcctaccaacgtgcaaccgtgatcgaccagaaaatgcttatccattatatacacgaattcgaacgctgctataaacattgttgtagcgcatggtggagaaccaagacatttggaacacaaaaatgcgtaatcggccatccatatagccgataatccgaatttgtgcttatatatatctaaaacacggcaaacgagacattgtctatctagagcaaaaacctcggctgccgtcccgataaacgtcgccagctcttgatgctcgattccgtcttcgcaatcttctgcgctttcgctaccactgcaactctgaccagcctgaagactgttggtcttaatagcgtgggcggagagtagcaattcgttaaagagcgtatcgttgtacgtcaatatttcaggatcgaacgctatgtaagggcattttaaggactcctcgacccatccttccgacgcggatgctcccggagatcgaataaacggtagttcgacagtacgatgggccatggccgctgagacaaacactcggcaagtagatacgcctcggttagccgacgcgatcccagacgtagagttgctgtcggacgatgtcgataaattagctgaacgctatatttgcgacgggatcgtatatcgcgtatggttcgaatacctaatacccgatgaattagatttgattttcccgacaaccgacgggaagtttaattatctatcattcactagaagacttgcttctgccatccgacatggtcgtgccggagctgggagtgcgacccctacgtcgtttatcagtgccgagcgtgtctgtgaccatggggccgttttgagagggcggagcgagagatttgcatccgtaattaataggttccttgacttgcatcaaattctgaaggattgttagaaactagcaagccgaacataattgctccgccgtatatctttttttcttttacgaaggcatacagcgaatgatgagcgcgcctcagagtaagccctgtcgtcgtgcaggactaatagcacggatcaggctcatcgtcggcggagatttaactatgggcaattccgatcccggactcgcggagtctttttccggtcgcgttccggcacgttgcgtatttcaattcagtggggcagacggcgtggagagcgcgtttcccgttgaatacgtaatgagaatgatgaacgattgggcggggggtgagtgcgatccctacattaaaatacagaataccggcgtctccgttctaatcgaagggtttttcgctcctccgacaaacgccgctagagcgccgctgtgcgccgacaaagtgaacgtcctgttaaacactaccgattctacgggcgtcgttttatctgatatcaaaaggtttaaaaaatcagtgggtgtggattgcaggcctttccaggcttgcctaaacgttcattgctttgtaaggctaccaaatgttcagctggccttcagattcgtcggcccgaccgatccggccagaacatcaaaactgctcgactcggccgtagcgtcttacaattcgaaagcgaaacagcggttcaaaaacagttcgagggctatcgataacgaatcgagaccctgcgcacttcatgagtgtgttccgatcccggtaagagatgaaacgcagaaactgactagccaatctgatataaggacccctaggcgcgtgctgaccatactcaagaaaatttcgagcggtgagtacgtaacgaccgtacgcgtctcgatccgcaaaattatactgtgcctggtcagtgtattcgtagttataaccgcctggtggtgctacccgctctaaaacctcgcgacgcggcgtcacgtttccagtcggaacaccgcaccacagagtcatcatcggcgccactacatcgcgcgagactgcaatgtctcgcacgccctctccccagctttcgcctgtttcacaagcgttcgatccctccgacttgagcacttacaagttggatgtgctggttaactaccccctctcggatttggtgcatcaccttaatgccataccgcgaaacctgcaagtttccgacaggcattccgacctgaacgcagctaaaatcaacgttttacgggctctttgtgtgggattttctgacgtgcggcgcaaaaatgatactcgcactttacaacgcacgcccatgttcgcaatcggcgacgccgcatcgcgcttgagaccgtccattggattgaaacggacattccccacgggcatattctcaacaactatcataaactctcccgcagacgatgatgcatagcttttgtgagtcgacatgctttaataaaaaattatccaaatcgaacgagtctacttccctatgtcagttatccggtcaggagcattttgattttaaatatctctatcgttaatgtatcgattctggctctcaattgttgtcgtgcgtgtgcgatttgcctggccatcttttcgcatgccctagtgagtgcgtaaagcgcgctgcgtcccacctgcctaaaatcgcgccttgtcaataatctatcggcagagattactcgggacgcgctcgattcgtccgtgctggagcgatcgctatcaggaacactagattgcgactcgccatccgtgttagaatccacggacgatagagactccagcgcaaacagatatcgctctgggtcgatattggagtcctgttgcttattttgccctgcttctgcttccgtgaccacgaaccctctgtacatgttgtgatggtcgtgctttgccgttgtcgccttgcatggcgaacgtcggcacgtattaatgggtttcgactgcgaactagacggctgcgcgggtctcgacagaatgtttcccagaaccgcactactcggcgacgaaggctccgctaatataacgtccgggggcgcaaatgcgaagtggtcgtacagtccgtgctgcgccggactcccgaccgccgcctgctttttgccaccaggtgccgtcgagatatcgacggagcggtcaaccggttccaggttaagatccgcggtaataacggctggcgacgctcgttgtaacaagggagacgagtcgcggcgcacggaagcgagtccccctaaagtatcgcatcttggccttgacgcattgttaggacgaacacgggcggcgcccttgtccgagatccgtccgattgaatcaatcctcgttccggcacgcgacggcttcagcgctcttatccctattcctccgtcttcgtcgtcgggaatcagggattttgtcgaagacgcgacaacaaatggtgttgaggtcgaatcggagtcagatcgatgtggaatgtttggagttccatgctttttcctatcatcgcgtaccgagttatccgaaataactacggcaggggacttttggtcgagagcgcagccgggtgcgttacacgcggctgccgtatcggtaaattttagcctcccacgatagacaggctttggcatatcgtgcgcccgttcgctgacatcgatatgttttacggggcgccccttctgcctctcctcgatcccgactgctgcgtaggtagattgctcgttatgtgtttttttagttacgacgagtttttgagtggctggagataacagggacgggctcaatgtttcattatttgggggggcgagcttatagtgaaaggcgagtttggaagaggcgccatcggaagcatcggtgctaaccgtagaaggacactcgacattctcgggaactacccggtcgctacgatcgttcaactctttatgaaacaaaaaacccgtttcagcattgtcgtagacgtccttctctgcagccatcccatcccacatgctctctctatcccgactaaagtcattccctggtaattcttcatcttccgacgccgttccaatagatagtacatcctcgacatcgccgtctcggctcttgttgtacacggggatcggatattgtctagattcgtcggaaaaaaaattagccgcgtcctgtcggtcgagcacggcgatgtcatcatatgacgcgcccgtttccacgcgaatgcccgcatctatgtatggcagttccgagagaacagcgtcatcgctggaagttagccgtattacggggatagggtcgaataccgtcttaggccatagaactttcacgggaaccattcccgtgtccactatcactaaacacggaggagcggaagaaaggggcttggaggctatgagatgggacaagtgttccagctgttggccgaggcatgcattttcgattggattgctgtcgtctgccaacaatttccccccccaggaagtcgtgtcggatgaaacggcggcaggttcgagaaagcagccctcggagccgcttctcgagtcgaaaagacggacacacagattcagtccagagccggaggaatacgcttctggacattctgcggcgatcacgatccgtgccccgaataatgtagctgcggctgccagatccatagcgtttacttttaagactccgctagggggtgtggacgtgacggtaaatgtcatcgccactcctgtgggttcatataaattgggaccgtctgaacctttcgggatagttttgtcggcgggacgtaacacggacgatgtggtcacgtctaaagtcgaagcagcgtccccgcgggctgtgacgacgtcatcgtagcttctacagctttgctctatctccgcgggtagaagcgaggaccacatcaccgccaatgcggttggcggaatgcacatacgagccagcactgttgtcgttgtcaaaagattcgacggcacgaccgcacgaattttggcaaggcccgtactcgtagccccacctacaccttcccagggtttaagggggtctgtttcggaaaggctgccttgtttccaatcagaataccgcaaagcaaaaagggatccgcctgacgggtcccacgctccgcccgttaaactcatcggtcggcaattcgagtccgacggggcatctttggatagctgcgtagataaacagttgataaacgccgtagtggacagcgactcattgatagcgccatagagcgtcttatccataaaatcgtactggctaataagatcgagctgggaaaaggtcaagacgtgccccggcatgcacgtcataatagcaaccatcacgtcggccaactccagccgaacgggtcgtccatttgcagctatttttttaagcccctttttgtcggcggcaggggcgacttgccccggaagaaaaaaaatatcagacaagctagcacccgttttacgcgtgagcgtaatggccattaatgcgcaataaatggacccgatcgcttttactgtgccatccgccagccaatcgtagttttgcgtacgtacatacttggtgaaggcgcggaaattatccgccgcggcttgaacgaaacccagcctcaaggccatgatgtcgcctagcatgcccgcggcaactaccatatctctagttgacataacttttgaagggatcgcgggcctcaggcttaggccggagggctcgcacaaacacgcggccattttttcaccaacagttcgatagcagacagaatatctcaggggcgcgtcggaggcgtctaaatatgtatggatgcctgggatatctatttcagaaaacgcctcctgcagcgtgacaacaactgatggtctgatccaagcagctactcggtgtttaagatatcgatccacgaaccccgcggccggtctgttgttcgcgtcagcattcaatcctgtatcagaggggaggagcgatggacacccggcaactcccggcaaaatggcggaatatgcagcatacagcgccaatctcagctttacaagccgcgagtatcgagttacgtgccgaacgtaccacttggggagccgtttagagagaatatcgaattgcgaggctattgtactgagatcgtttaagacaaaggttggcgggatctttgcacacagagtgtccatctgtttttgaatcgattccgtttctttgagggccgccagaaaagcatccatgactccggctctgtctctgtatttcgcatcgataagtccgatgattttagccggcagcctagcatactctgcgttatcgcgcaaagcgttgatcgtattggaagagactttagcgcgagcagcactatctcgggcggcggcaaacccctctgagctcttgtccatcctgtccttatcgtgcataaacgtggaccatgtgtcatcccaagcgacttcggcaagcgctagttcggattttaactcgtccaatcggctcgctaagtccgcgagagcatcgatccgctccgcgtatatagtcatcggaccgctttcgtcgatccgggaagttagctcgtgcgaatctatgacagatcgggcgtgttttagccactctaccgtttgggtatccaattctttagtttcttcgactttactcaaaagtattgccgcttgagtgactatgtcgttcgcagtttcagccttttcaatagctttcgctatatgcggaggcatcgcgaccagccgcagcaggttttttaaattggccaattgctccgccgtctctctgtctgcggcataagaaacttcggccaaactcttcagaataacttcagctctcgatttcgcgccctcaatagctgtcgttacccgcagctttattgaggagacggcttctatatcgcgttggagagtatgagcgctatactctgcataggctgtcccgttgaacgccgtaatgtcttccttttccaaatcgttggttattgtcagtatggcgttcgccgaaggaatcacgatagagaccccatattcaagagcgcgacgcgccccctcagggctatacattctagccagattctccaatgcctctctaatttctatatctaccctccccgctgcgtgaagagcctctaccctcatttgttcatgccgagctaaaaagcccgtaaattcctcatgcccgttacgataaaaatccacgtatttggccaacgttgggaccgctcttacgtctggttcaatttcgcccaataacgtgtaatagtccaagttcccgccgcgggcatccgcgtgccttaatatagcgagtactatcttgattaactgtagcaaggcgtcgcagctaactccgaaaagttttgtgtaataaggagccgccgctataaacgcgtctagccaggtcatatttttcaaaaatgctataggaggcagaattccatgaattctattcggggtggaaaacgggttgaacttcaatacagtttctatcgcatcgtgaatcgcacgaccatgcgacataacaattttctcggctctggctctgaaacggatagtgtcgtagccggccaccacggcccttttctccaaatcactcatctccatagcatcaaattcggatttcagctcggcattggatagtagggaatgaatcgaggaaacccaaacgtcttcgctatgcgatctctgggcacttatcagatttctctcgtaggttgtaacggccgcctccaattctacggtccgctgatttacaagccctaccgattttgccaggtcggcaattttacgttggatgtgggggtccgtaacatgcgcgtgactctcgagagctgcgatggctgtattggcgtctctcgcgctctgcagcgcgtgagctatttcagttctggcgctcattataacactggcgtcgctatcagcggctgctgttttgggatctgaagttttgaccttggttattgacgcgatcacgctattgagtgccgcgcgcactgcccgatgtagaccatctaaacggtccccgtgctgcgccacgcccgcggccacctcagcgtcggataacagcaccgttaagaacgaaaacgcgtcatcctggcctgcgggtagatcggccattattcccgtagagggagtgtctgcagtcgccctgtttacatcggatacggcgttctgcagcgccgtaacagccgccgtagttttttcgaccgacatcggttcgaggcgcgcagcggcgactgctgcagaaagcgtatcggcatgtttcccgaaaaaaaccgacgcggccggataacccccaattggacccaatattacgcgtatggccagagagaaaggaatgccgaggccagataactctgcggcagtgctcgtactggggtgtgacaaaattgtcctatactgagagaacaacagccacaaatccgttcgcaaagtcccaataacatcgggtggtgcgagagctagaaaggtctctagcggccccgtatctccagggatggattgcgttatggttttgactgtcgagtccaatgcgcgcaacccagcaaacctttgtagaggacgcagcatcagcttaatcgaagaatataaagttctgatctcctcgtaacgatattgaagtgccgcaattaaggtttcggcatccagccgcctacgggcgatagccgcgcggtcatccgaacttagcaaatttgcaaatttgtcgccccctaaagcatttgacaattttactaactcaaccacatccttcataacttcctccagtttttgaagatcggccgttgtctccaaatcagtgtatgacgcaactctagcttccaactcatgtaagcggtccaaatccgccagggctgtttcacggcgggcggcgttgttgttaacggcatcgacttctttgatcagtgtttcaaactcttgtcgactaatccacccgcccgcttgaacggctgccattgccgttttccataccgccagattttctggattttctaaattagagtcattttccagcagatccccgagcaatttagattccggtgcagttgttacgggcggcggggcctgcgcgccactacgcgccgctactagggcaataacatcatcgagcacagataatgatgcgaacagcctggccattttttcatgttgctcgacaacgaccattttaaatctagatgtgctagccacgttggctcgaagcgcattcgcgctatagagagcccccttcaagtaatattcgtgtagtgcgttgccgactgcatcaacggctgccctctcaatagcagtcaagcgctgtgtaacgacagatggggagactttagctatgctctcgtcgtcgcgcgatccagaagtacccccagatcctcccattataaatgcatcaaatgaggcgtgcatcaatcgaacgccggcgtcgagggcctccaattcagctagtatgagttccgccttcctcctggcaacagtttccctatcacgtatgaacctgcacagcgatgcgactctgtcggtcaagctctgttcggcatgcaaagacgtcttctctgagtatatctttcctggattactattaaacgcgcttactaacgatgtcgccatcctttcgtagattctatctgcatccgcagtgctcgcctctctctctatagagtccaaagttttgtgaagggcatctgtgagctcctccacttccagagccactaataccagcttgcttagggccaatttgcctatcttggaattttcagaaagtacagattctatgaggtctgcagattctccggctcgcgaaaccgccattcccgtagaatcaatgaacgcgctaaagtgggcgggcctcgtaaatgctttaaataatgatgccatctcggcttctacgacagatcctatttccgttgtggttcgagcgccgttttcgataacgtagttgaacaatctggtaaaagtatccagcccacatatatccagaagtccgtcatagtcacccgaccgtgacaagtggatggtcattcccatacttaaagctatagattgctctaaatcatcgatgttagcattgatgtcgctcagaatagagctagggacgtgttcgcttgtccatagcccgtctcgtagcgactcgtccccttcccccgctaccgtgtgaggattaaaaggtggccggtctcgcaacgattggccgtgcacgaagtgctcagcacgcgcctgagaacttataaactcattgaaggagacattgtccggccgggtagcttcttcttgaccaggtatattatgtgtcgtgctcgatccactatctgcttgttcagacaaacttatcgatggagccaccggattgtccgtataggtcaaacatcgtttagttttccgggacggttttctgctcgaagattgaccttggccatcgacggataagttctctgaacttgacggaggagtccatacagggcgcctcctcttatgtctctcaaaagactgtttgggcggggagctagatttcgtgtcagtttcaagccgaactacattttcccgcgttttgggcaaatcaggccttgttagcaccgacagatcatcgccgatgtccgggaatgcagtggtccacgcatttacgatggactcatgattggttatatcacatatggcatcaactggagcctcctcgggaggcaggacgtatgcgtcctcctccgcatagcccatttcccgcctaacatccacatcccctgcagcgacgggagaacgatcacttctggaatcgacagcgactttgatgtcctcgctacgtgacgtggaggttccaatgatgatcctagttgttgtaggctgtggcctgtaagggggatcgagattggccagcactactttaatgttctcttcctcgttaaccctgcctagatccaaaacgatgtccgctgtaccgtacagccgtgatacggctgatattatttcttcctttggcggtgtactggagatcatagatacaaagtaaacaaaggtcgcggaccactctggcgccgtcgagggatccgcataggacgtgagatattgataaaaataaccctcgcttactcgaacgatacacgcttggcctatgtggccatgaccgtgtggatcgaaaatgtagattccgttatcggatctgtacacccctattcctatgacgccgatgacgatcaggcaataaatatcacctcgtttctgcttccatactttttctatgaatgtccgcgcagatatttgggtttctaagatagtggaggtgttttcatctacgtagaagtccaattctccataggagctcgaaaacgcaacacacaagttgccgtcgggctcatttgataagatcctgtttggtaaatcgtgagggacgcaagtcgtataccttccatcgcgagaggtttctattgtccattcctttccctgcaataacagtctatctatggcctcggtcgacaataccgcatccaacccatacgcaaaaactacgcgcagaaacgccaatgacgaccgcaagcatgaaaccgatgaccccggactcaagtccggggcaaattgattcctgttgccaacggcaactagtgtaaagtcggtggcatcaaccaccattcttgcccattcatctaggattacctccgaatccatgtttgttcccgaacgcatggcgcggttttgcatgttcgagacggagctgtccctcgaattatccgatgtttccaagcgccgcgtcgagggactcggttgtaaccgcgtagatttcttggatgggcgtgtagtgctccctctactctcactagcagccatatagacgatggggcggaatggcgcgtcttttcagattgcgctttgtcattgagcgagttagacattaaaagttgattaactccaaaattgtgatcaatcagttgcggccgcgtaagtggcgtggctgcaacatccaagtcggcacgaacgaacgatacgccaggccgtaaaacgatagacgtgtgcgtcacgcattgcgatctctcgcctgcctttcgttattaaacaccgtatcgacaatgtcgaccaaaccgtctacagttactctcggttttatgaggaagtccttcgcaaaattggcaaggtccacatcatcgtgtgccaccgtatccaaatccaatgtatcaaaattgagttcgtcacgatgagttaaattgtgcctcgatgtcagttcgactactagggcggggctatcgtcggttactacgggcagacggcccagcagggtcgctacagctgcgtcgatttcgtcgttcgtgacacggtcttccatatcacgcggaacctcgatccgatcagctattttttgccatactactcccacattctctatagcactggccaagtcctgcgaacttctgtcacgaaacgtagaatttatttccgacaacgtttgccatttgtccagcagccacacgatatcgccggtcccgggcggcgtggaacacgatgtcaaggctctgacgtgcaggtccagcgaattctgcaggcgagccaatctggcatagtcggttccgagggtagaaaaatagcttgctgcctttacgctaaataaaattgcgcgctccattaaattatcgcatgtatgaacttgtttcccagtttcttctattaaagtccgcaacaccattgatttgagtcttacattcgccattacatcacccgaggagtcgtagaattccctgagagccgacagcacatcaacgattttccatgtgccaaaattggcacgcggctcgccacggcggtaaaccgttacagtacctcctgctgtaccagctgcgaatttacacgcaaagaaatgcttaaatatgtacgcaaatttaaccaactgcctggatcgctccgctaaatatgccgcacacttcaacgttctatccgctaagtaattgaattgaagtcctagggccgttccatgcatactaatcaaaagcaaactattcgatatctctggacgggggggcataatcggtctggtctctggcggtaccatctgcacggccgcatagaccacgtcgtacaattcgcccatcagcatttccagattatacgcatcgtccgtggtaggcttggccgtcagatctctagcaaacggagcgagtgaggaaattagagcattgagcttgtttctatgattcacgaaactgccaatgtacggcgcgccgtaatccctggcccaagtcaaaatttcgataacagtgtttatcgggcgttcagaaaagacagatgtcgtgatagccgacaatgcgtccacgcaaacggtagctagaatatatcttagaaaatggggagttgtgctttcaggtgtgatgggcatggattcaggatagcgaattgtcatggccagacgaatcatacggctctccaggtctgggtccactgcatttggtccagagatactctctaaatccgaatggtccacactagctagatgttccgacggttcacctccaattaactcttccggtggcacgattccccatatatgctcggctctggagtcgaaccatagcatgagtgactcctttgcaaattgtattgctcgattggcagtcccggccccgctctggcggattgcgctatccatttccgcggcgaggatcgctcgtgcagactttacatagtcctcgtggggatttggcggtatacatcgccctaatatctgagctatgattgcgctatctaacccaagtacttttatgaaatctgaatcggcgtccggaggaaggccattgtccatataattggttaagtaagtcatgccgggaccataactttccatgagtccgaaaacgatgtttccgatgacagctatgcatccgataacctgttgtacgtcgtcaaatgtgtcgagttcattaacagtaccacgagtttttcccaaatttgcctttagcgccgattcataaacccggcatgcctgtctcacaaaacctctttctataagcgcttccaataactgtctcggcgacgaactgtgttgtacagccccccatgcccgcctagccgattcggagagtttcgctttagcagcatcgagagcgcccccgccgtcatttaagtcgccatcggtaataagccggaccacggcagacatatggatcgctaaggcatcttctgttaatgcgtgatcagctaatataatgtctggtccgttccgcaacttttccgctaccatacccggctgaactgcatatacatacgggtctccgtatgctatggcggcagatgctctaacatcatatgctgttcttttcatattgtttgcctctacggccgagataagttcgcgcgagcccaatgcgctggcatcttctgcgaatagatcctttaactgagaaggatggggcgatcgcggacttttaaaatattgatcgacaagggccagcgtaaatagtattcgagtgagtggcgtaaaggccctatttgttgtacatcgagacataataacaaacggggtgatccacccgacggctatagaaattaatcgaattccttcctgaacaaacgggaaatcgtaaataagtttaaagcgcgtctgcgtcaaggaagctggtagttccaaagcattaggagcaggttgacgtccggataacaacccttcggaagtataatcaaacgcgtccgtggcgatctcttcaaaaattgtcagccactcacttattaggggccacaaaacactcggtccaaaaggacatgatctgcgcagaccgtttcgggtaagccacgcaatggcttcttctcccgtcatttcggccgccaatctacgcaacctacgagaatcgtctttccaggacattttatcccaccttacggaggtacgccacaagatgaatccgacaaaattttgggccagcattgccgcttctgggcttcctgtttgtttgtagacctcgagcacagccgcgaatgcatcgcgccacgtcgattccacttgctgaatactcattgtttctagagcctggaaaaatgatccgatagcagttcttgcttccgcagctgtagcatttccccacggttccagtggcgccgttccagccgataaagaccttagtgtatccagtaaagttttcaacgggaatctcgcttcgccctgggtttcagacatggcgcgccaataggtagggatggatctacgtatgtcaatggaggccgtataaagcttcaataataatacgttccctaaaatgctgtgctccgcaccgcagaaaaatatcgtgtgatccgcagttacaccataccgtactttatcatctccatgacgcatcgagatcccgtataggccggcccacgtaagaggcacacgcgctacataactttgttgcgtttaactacaccgccagtcctgtattgcagtatactaggtgacatacagcgatttttatgtgcagtagtgcacacgcagttgtcgcaaaacgggcttgcaaacgatcatcgccaatacaggatctctttataactggttgttgatagtggacgtcatgaaaaccacttttcgaacaagcgacgtgcaggcatccaacacgcagtcaaatgcctcggacaggctgcatgacatcttacggagcatcaataactcaatgcactccggcattgttcggcgcatcaacataggctatccgcatgcgggcaacaggcgcgggacgttgaccgccggattggaactgttgagcaatacgatcacaacgacccctcccggggcaaacatacaccgctccattgcaaattcggcaggcgaagctacggcaacgatcatacaatctttacgaacatattccggaagtggagatctgaacacgaatggtgataataacgtcctttcccgacagatcagcctgacagatttctgtttccccgatgcggagatgccaggactaattgtcttatctatgcgacatccactggatataaacagcgaagcattatacagcacacctgccggacgggacccacgggcattggagtcagcgtggtatgaattatctgaactggccgcggtatcggtaaacagattagacggaagtggtgtccggccgtccctattatcgctctcatttcttattgcttcccgcgcgggagactatgcggataaatgtggtgctgaggctgtaagagctcacgtgattagcaattacggccgccggcggatagaggacaggctcgacaggttcggaagctgccaagcagcaatgttgagatgtcacgtgttcccacaccgacatatgcaagtattagggggaatggtgtcgtggatcgcacagcgcgaaatcgccagtataaccgccgtggtcaagggctctcaagagagcgccaggacagaacagaccaacaatccaagatcgtcggtatacgttcccgcatgcgcctatctcgatttagataaagagattcacatgctccatgatgacagagcttcttcgctactatacctcgttttcgtttatgcacaacacctcggacgcgagagcatccgtgtatatctcatgcggagtcgtttaggggaatcggtgttcagagaaggcctcggttacctgtactccgggctaagagccggtaacgctattaacggtctggccggtataatagcgccacatggagtagacgcgaatacggaatttccattatcaaaagctttcgaggtacacaaacacgcctgtcgaaacaccggaatcggacctcgagactccgagaaagtggactggcgtttagatctccgaggccgccctacaaagaattcctgcatgtacgcagcatactgtcgcgtagggcacttgaacgagtattcgatgccggcgaagaagtctgaacgttgtggcgggtctgtggaggtccctgttgtatgggtgccgggagtagtgtgggatatcggagaatggaccgagtgttatcagtagagagttggctacaccgagatccggcatcataccttacgtgaactgcttacgtttggggatgtttttgcgtcggtgtttggggaggagtcaatcttataaaaagcctatttgtggtacgcttcggtctcgcgctcactgagcaacccgtattttatccagtctgaaatcagaatctaaaatgcagcgatccgatgaaaacgaatccctcgaagcgaatagaaatttggacaccgcctcgcgtaactgtactgatgtgcaggtagccttgataatggcaacgaaattgcatcgcatccagcagcaacttgcgagcatgggatatttatctggctacgattccgtgcccgatattactacacccgtgaaagttctgcgcgagcgcattacccatctagtaaatacattgaaacccgtttgccgtttcgatgagcgcgtgtactacgcctgcggggagctggtgcatttacggatcaaatcacaggaagctacttttgatgcgtggttgatgtcgaaaaaattaagcctgaaaggcgagatcgtagataacatacagcgccacagaggtcacgtagagacggatatgctgcgcttttacggagtaacctatccctggctgaaacgactgggtttacagtcggcgttgaaatacgaagaatatctgactgagttggaagacggcaaaaaagaatctctttgccagttttttgttcggctggccgcggcggcagcaaccgaagcgtcaaacaaaaaagctttcatgtcggctttgggtaccgaagtgtcgacctgggaaacggctttcacggctttttttttcgctctcgctcgtcagatatttgtcccatcgactccctgtatgctttttttggggcgcgaaggaacctcaaccgcgagctgttatctcatggaccccagaactataaatacacacgatacccttaaagcgatcgccgacgatatagttccccatctcctagcgagaggagggatagggatatcgttgcagcatttaaaccaaaaaacaggccttatgcctgtgatgaaagtattggattccttagtgatggccgcgaatgcgggggagcgtcgacccacgggggtatgcgtttatctcgaaccgtggcacgcggacatcatgtctgcattaaatatgcgcggcatgatggcgacggaagagtcccgtaggtgcgataacgtatttatcgccctttggacttgcgatttactgtttaagcgctacgagagacacgcaaacggggagaaaaatgtgacgtggaccttattcgattcccgcgcgtcgatattggccacgcttcacggatcggaattcgaaaaggagtataaccgtttagaagcggaaggtttaggcgtagctagcctccctgtaagggatttgatgttcgcaataatcaaaagtgcggcgtccaccggtagcccctttattctctttaaagacgcgtgcaacaagcactacattacagatactcaaggagacgccattgcaggctctaatctgtgtaccgaaatcattcaaaaaaccgacggaaatacaaacggggtgtgcagcttagtaagcgtcaacctcgcccgatgtgttttcgacgagaacggagagaaaaaatttgatttttccgcccttagacgcgccgtgcggctggctacggtgttcgttaactcgataatgtctagcagcgatgttccgactgcgaaatctcgttccggtaaagatcgacacagatccatgggcataggcgttcaggggcttcatacagctctgttgtcaatgggtctcgatttgagcgatgaacgcgtcaagcccctcaacaagcagatttttgaattgatgttgttagaggccatgacggtcagttgtgaattttgcgaaggcgggttgcccgccttcgccgacttctccaacagctattactcacgggggcgcctgcattttgatggctgggcaaacgtaggcttaagtatgcccgaagagtggaatgcgctgcgggagagaatacaggcgtccgggttatacaatgcccagttcgtagcgttgatgccgacagccgcatccgcacaagtaaccgaagtgagtgagagttttttgcccgtgttcagcaacatgtttaacaaagtgacgacggcgggggaactactgcggcccaataatcaattaatgggagagttgagggagatctatgcggataatgaggatcggcgattgaaagccatagcagcgttggagtgcgcgaactggtgcgtggagaccgctctgggaaataagcccgaatgctctcaattacttaaatacaaaacggcgttcgagtacgaccaatccctcctaatagatttgtgtgccgatagggcgccttttgtggatcaaagccagtcgatgactctgtttgtgacggaagcggctgacggaacgctgctggcgtctcacgtcatgaacctactcttacgcgcctataaagccggcctgaaaacaggaatgtattactgcaagatacgcaaggcgactaatgccggagtattcagcggtaacggcgaattgacctgctcgtcctgcatactataatctccaagcatcccggcattttgaccatggccacgcaagcacgcgggaacgaatttgtcagcggccaaaccgcacctctgcacaaaaacccgtgtcccgaaaacgcggcggccgtcctaaagatggaaggtatcgagatcgaaccttcgactagttccgctagagataattacaaagtgtcacggtacttctacgtccccgaatgcccagatatagggcacctccgagctttgagtattatgaaccgatggacggagaccgaatttgtcgtcgccgaggatctcggggacgtcgccaagcttagcgaagaagaaaaaaatttctaccgattcctctttacgtttctctctgctgcagacgatttggttaaccttaatatagacaatctgttaggtttattcgaacaaaaggatattcaccactattacttcgagcaggaatgtatagaagctgtccactctcgggcctatagcattattcagctgatgttattcgacaacgactcctcggcgcgcgcaaaatatgttcagtctgcgttagagtcccccgtcatccaatctaaattggaatggttagaccgacgtatactagagtgcacgtctataccagaaaaatatatccttatgattttaacagaaggcattttcttttcagcatccttcgcggctatcgcttatttgcgcacgaataacctctttgtcgttacatgccagattaacaacctgatcagcagagacgaagcgatacacgtagaggcgtcgtgctgcattttcaagaattatatcgctggcaacaagccatccaccgctcgcatccaagccttatttagcgaagccgtcgacttggaatgtgcatttctccgcgcagccgcaccacgcgactctcgcttattggatattggctcaatctgtagctatgttcgttacagcgccgacagattattgagaatgttggacgtgccaccgatttacggcgaacccagccccgctgccgactttccgctatctctaatgtccgcttcaaataatacaaatttcttcgaaagaagaagcaccgcgtactccgggagtgtatcgaacgatctttaattagcctgtgtgcaactgtactttctacccctacccacaagaattaataaatgaattcaaattatcgcttttcgcaccgtgtagtttgtgatgcatcccttccccagtaccttatcagcacggagtcgaaaggccgtacctccgggatacaccttagaaatgcggttgaaataactgaagcttcggcctcattgggtatactgcgaaacaccaattcttcaaccgctacatcgtcacgtatatcctgcattatggggaatcgttttaaaatactaattctgggcgttctgcgctcgggcattatagtcgcaatgacgtgctttatgaacttgtattcgagaacttcgcatctcgtttttggggggtgcaaagatcttaacaagctgtaattggacgcgagatccctgttcgcatcgggcatatcagccggtctctcgtaatgatggccgcccgtgatctcaggattgcaacaattcatcaacgacgaccggccacgctcgttatcgctcgctttaccgcagatagtgcccgaaccctgcttcaatgtccctagatctattatctcttgcatggatttcagtgtgtgttcgcaatggaggtctgtttgacaccgaacgaagttagacaaaaacgtgaaatagtccatttttaacgccgccaaaacatctctgcagtagatagtcggcggaaatattctagtaaggtcgatgattatatcacatcccatcaatagcatgtctgtatctgaagataacacatacgcaaccgttttggtgtgaaagaggttagcacagatatcgtccgcttccatcatggccacatcgacataagggtatcccatatagcgaatggtatccatgcagagcctatgtagaattttgggcgtatcagacttatcgctccatctgcgtggtcttttccgcttccgcgttcttttgttccgcgcttctccggtatccgcattctcgcattcgtcgcgcgaacgtacttgcagcctcccagaacctcctcccctcgcgatgcgagtagctgctagcgcctttgctccataaagcgttttcccatacttcgaaaacccccggtccgatacaaacaccggataatacgaccgttggtgtaacaaacgcagcagacagtataagcaccgcagcgtggcgaccgagttgtcgactccgtcgaccttaccagggtaaattttttccagcagtccatacataacattccataaatccacggcaatgggcgtcatagccccgccggatatcgaacccgaaatgtgacttctcactaatccgttcgcataggcgaagtgcatgcaaccgtacacgcccatggcaactttcggagtcgcagtgtaagagacacggggtaatacgaattttgaattttgggagtatctgtcaagtatattcaactcttgaataaccacgaccaggcgtagctatccaaatgccgaaacgttaagccgctccataaaaccttgattccactattcaattgtgcaatagttggattagggcaggtattcggctctatctgttcaccgtatacacgctataccgtcctttaaattagacaaggtgcgcgtctctaaacctataattcccggtagcggtataagcgacacttattacatgcctatccaccacgtgatgcaacccacacgattcacgttgaagacatgtgacatttgctgtaaatatacgcaggtaacaatgtgtgcggcgaattagacttacagccaatagtaagcgcgacataacactaaatgggcggcgcgacattcgagtgcctataggagaccgatatacgtaaccacgcgtggtgcgattgcgacccaggctccttcgatataagctttccccctcacatccggagccatccgttagattgactctgcctcagcctatacaacgcgccaaagaacagtgtgctacggacagaagtgacgccgacttgagttcacggcatcgagaccccagaaccggtctcggcgatggcgcgaataactatgagcgatgaacacatcatagacgatgcaggggccacttctaacgattcgcccaattcctggaaagtcgtcttggccggagagaaatttagaacggtatcggctgcagtacgcgcaatagtagattctgtgaagaatcccctaatcatattcagcgacgacggattaatgatacagggcacgatttgcggtcagcaaacattcgttcctatcgagtgcgccgcctttagtgaatttgaatggcgcgggtccgcggccatattcctggcgctaacagattcgaggcgtactttattagacgcgtttaaatgcgacaagaaaaaagcaatcgaggtctcctttacgttccgaggggaaccgccgtcgcgacatctaacccagacagtcacgtatgtaactgataacggatcgttctcgagtgctatcatcaagtatgaactgtggtgcgcctcagttttattcccgcaaaaaattcccgatgttacgttctcagtaaacaaacagcaattaaacaagattttggctatagccgccaagagacggcacgagcaactaacatttgcgttgaaagcagaaggggggttttatgccggaactgtgtgcgatgttataagtttcgatgtagacgggagcgcaatgactcagtatccgtataatgccacgactgcggtctcgtctgccctcgtcttagcatgcgggaagaaaagagccgcccgtaatgcacccgtgactgcatatgggagcggaaaacctttctgcctcgcactggaagacacgaccgcgttccgaaacgtcgtacagaaaattaaaaccggctcggcaggggcagatttgggattttatacggcgtgcaatccaccgatgctatgcgtgcgtccgcacgcgttcggcagcctgaccgcttttctattttgcaactcggattgcatgtctatatacgaattggaggaagcgagtgtagcggtcggcgcagtaacatcgaaacgcataaacgaatattttcccagagtatcgaccatcgattcccggaaaaggcgcccgtcttcggtcctctcggagggggatgggaaactccttaaacccgacggccaataggtctcgtgtccgcgcgcggaccacagtcatgacgcggggaggtcaaactgatataagatgtgataagactgcttagatttcattcgacctggttattcggacatacatggagcccgtcgacaacgcgtctccgttacctccgactggcgcgggacactgtcttcataggattgtttgcatcgaccctccatgtacagcaaccattggcagcgggaggagcggcaataggtgcataaaatgtattatggttacgacgggctccctgttatcgatggccgcacacttgaccgtcaccgtattttgcgtttccgtgattccgtgtatagatcgaaccgcagcctatccacgctgcactatgggcgccatcttcgcattcctattcttttttaacatgcggcttactgcacgatcatcggaaatagtgctgctcattggcagaccgacacaatttttatgcgctctgacagcatcaatcgccgacacggtcgccaaacatctagcggctacccataaggattacctgacgacattgcgagcaatagaagtaatgtctctgttgacttttgtcatgctcggagctctgatcgcatcttatcattacgtctgcatagcaacgtctggagacgtgacgtggaagaccgggtttttagttgtggcggcagggacgattgccggcatcacggctccgtatggagacatttctcctctagccggctttctttcggcgtatacggcgttagctattcacgtggtcagagacgccagtcggtctctaatgaacacgtgctactaccgtgcacgtcgggaaattactgtgaacggtgcatatcgcctcggtcgcgcgcgtctcccgcccagcacggacgccgaggcgacgcgcgaagaagacgtatccagttacgatacgctgggggggaatattcctacgataattctgagcctcatagcggtcatctcgattccagccatagccagctttcaaaagtacatgtcgaacgcaactaagcaccagtcaacattgactgacacgttacgcagtatatgcggtttcttggtgggtacaagtgtcgcgatattccttccgtcgcgctaccacgaggttctgttccgtccaattcttgtattactgttaatattcggggcaatggctactaccttagccggcttcggtttacttctcgggccgacattgttttccgcgacagccgcggttctgtgctgctacacttgtataaatgtacgcaacgcgaatagcggaataaagcaattggcggccgccgcagctggtaaatgcatattaggaactgccatctcgagcatgttggtttgcgtgttaatacaatattcctgatcgcggagcgattaatttttatatcatgtgctcatagcgttctttcgaactgcgaataaaactttcgtggctactaaaggggcctatcgtgggtttatgcgctgtcgaaaacatgaaagggccgatttaaagctaagttgcgcaggcagaggccactccatatacgctctcggagacgcggctcgcacgccagctgaaatattttccccatgcacgcgtcacgcgcgttgcgagctttggggtggacgagactcttatttgtcgttttattttcgggccgcgtcctaagcgctagcattaaccccgatctagctacacccccggtcattgctttcaacccgtcaagtattccggccgatgatgggcctttggccaaagttcctgcatccccgccggcaggggagaaagaggagagccacaagaatgcaagcgacgcgcgtaggatgcctagtatagtttgcgataaagaagaagttttcgttttcctgaacaagaccgggcgtttcgtgtgcactcttaagatcgcccctccctccgacaacgaatggtcgaactttgctctggaccttattttcaatccgatcgaataccatgctaatgagaagaacgtggaagcagcgcgtattgctggcctctatggggtgcccggatcagattacgcctacccgcgtccttctgaattaatctcttctattcggcgagacccccaagggaccttttggacaagcccatcggcacatggagacaagtacttcatatggctaaacaaaacgacgaatacgatgggcgtggaaattaggaacgtcgactacgcagacaacggttacatccaagttgccatgcgggatcctttcaatcggcctttactagataagcacgtgtacatccgcgtgtgtcaacgacccgcctcggtcgacgttctagccccccccgtcctcagtggcgataagtacaaggcttcatgcatcgttaggcatttttatccaccgggctccgtctatgtgttctggaggcaagatgggaatatcgttacaccacgtaaggacacggacggaagtttttggtggtttgaatcagcccggggagccaccctggtatctacgataacgctgggcaactcggccatcgaccctcctcccaagatttcatgtctggtagcctggaagcagggaaatatgatgagtactacgaacgccactgcaatcccgaccgtatatcatcatccccggatatccctggctttcaaagatgggtatgcaatatgtactacgcaatgtgtgccgttcggaattaccatacgatggttagtacacgatgaacccaaacctaatacaacttatgatactgtggttacaggtctttgcaggaccctcaagcggcatagaaatatcatcagccgaatattactccaagatgactggcagaaaacaaagtatacatgtcgtctcatcggctatcctttcgacgaagacaaatttcaagctttcgattacttcgacgcgacgccatcgacgagggggtcccccatggttctcgcgatagcggctgttgtgggactagctttgattttgggaatgggtacactcctgacggctctgtgtttctacgcctccgggaaaaaatacatattactttcgtccgtctagtttgcggtgacattgatctggctcattatatgccccgagctcttgtaacatcgcggacgcgatttccgtagtaggcacatctcaaatgcaaaagcggcatgtcaaccgtataggtacatccggccctgcttacagtcggtagggcatatatccaccggaaaacttcagctttagactcctcaggtgatgaggaatagtatgtaaccctctagcagtacggtatttctaaaaaaaggtagatccttttccacacggcacagactaaataacgtacactacacaggttctctcgaacttcgtttggaccggaattattccctcggcagcgcctaaaaagcaaacctctagagtagataagtgtcagtgaacctaggccttctttgttccacggctggaaagctaagggacgaggtacacgcgaccccagccacgcacgaacagagtttaacggaagcgtcgtttgcgggataaggttgtcggaccccgcgggtccgttgaaaagtggctgcgcgcctaccgacgaatacgtcggtaacaattttagaaatcgaatatgactgcgagtaccgtacaatcgcgaaatacggtctctatatagctactcggtccttaaatatgtaagtatgatgtcccctactcccgaagacgaccgcgacttggtcgcagtacgtgggctgctccggatgatggacgagaccacatctgagcgacacaaacgttcgcgttcaggatgcccccggttgttatgcggttgtacgatcgggatcgctcttactgtgttcgtcatcacagctacggtcgtgctagcttcgctgtttgcattctcttacatgtccctggagtccggtacatgtcctcacgaatggatcggtttaggctatagttgtatgcgcgcgatggggagcaacgctaccgagctagaagccctagatacgtgctcccgacataacagcaagcttgtcgactttactcatgcgaaaattctaatcgaagctatcgcgccgttcgcctccacggacgccaatagcagcaacgtcttccgactacgcgatagtagaacaacgtgcgtacgccccactgccgcaggaccggtggccgtcgactgcccgaggacctgtaccgccatatgccagcggccgcgcccattgagtatcgtcgcttcgataatcagggacgcccgtacttctcttcgtctagaacgtcgcgaatattacgaagtttatacggccattctctcaaatggcagcgtgaaataaacgcgagagaccgagcattagagtagcacttatttattctatcgcagagaaacaccgcgtgatgcggcactcgatctcggccataatggccgttaacccgggaagctttcgccgcgctttagtaaaattaccaggtttgcagacaggggtcccgcgggcgggcagtctttctttcctccgtcgtaaattaaatcatgaaagcaatagttaggcgaagagcagacatcggccgccttcatcttgcacgcgttccgcaggacttttgtccatttgattacagtcccttccggaacgtttctgggatcatcttccccgaggacagcctgagtgccttccaaaaagaggacgtgtcgcgtcgcaaaagttaggcgcgcaagacaagaggcgagaactatcactaacatgttcatcctgcaatatgctcccaagcctactcaacaggggctctccccggctgaattctcctcctaagtgttcagaggcctctgctgtaccatataactatcgtgtacgcccctcccagtccgtgtccgatactgccccttttgagaggattgggagattagagaatcgaaatgattggagagccacattcagacttaatcacatttttattgagtcgggcgagcttagcgcagacgggttaacaatcgcaaccagttccacaagttcactatcctggtcagcccccttgtttatttcgcacgcaaccatgggtccaaattttcgcgattcccttctagtttgggaacgttcttcgtcgtcttgcgagaccgtgtctaattttcggtgcggggtgcacatgtttctggtgacgatggaaattacaatgacgaggccgatcgttgcgctcacgacggcagccacggttaccccaattagcgtagggctcattgtcccgagacggacagtaacgtttgaattttcgtttgcgggtgtcggttcgtaatgatccacgccattttctagccagggaaaggtaaagtgttccgcttcaagttcggaggcgctggttgcagtgacgggcgtcggggttgtcgcctcggcgctggtcgtcgtggcctccgtggcaacgtacgcttgccagttgcgccaactttcctcggtcctgagataggcctcaagttggacggtaggtaatccgaaggtgcgacacgaagccttggaatagagtccgcgagtcgcggcggtgttcgcgaattgatacaccgatagttggatcgcgaagacgtcaatgggttctttggtgtcgtctagccgaacaattacgtagaacatcccgctgtcgttcggacgaggatttcgtatagtgagcttaaacgggtgtggaggtccggttagtctgttcgaggcggagaacgtgtactcggtcactttacagccgacaaaaacagaagacgatcgatgagtgcaattttcaaagcgctcctcgctaagttcctggtagcactggtttgttatatcagaccgaaacgcgacgcggacggttcctgagtagggtttgtggggtctctggccaggcatgaaaaatagctgcagttgaattgtagcttcggggcgaggcgcgacgatcacgatgtgatcgtcgtcaatcctggcggagacgtgatttccagtgatcacgattcccatcgcgccgaagggtgcgagcgtcgcggcaaggagagccagagttccaagtagcgatgccatgcttttcgaacgtcccaatgaataggcattggtatgctattccatgtgatttatattatgagcgtgaggcgtggcatgtaggaagaaaccacctattctaggctcgattagctacgcgcgcattttacgatgctccaaaccagtagccccacgagcgcgaccgcgcaggctacgaacgccgcgaatatgggcatggagacggcattagaacttttagtagtctcctccaccgggatcacggcgggcatgtcattgtaatagtcaggatccgagtttggatcatcgtgctcggtgtcctcggggacttcgtcgtcttcggggagggcggcaggattttctccagaagcctctgcctgcatgtcgtcctccgagtcttctggaggggccttcttttcgctgctttctgcgtccggggtgcgcccttccgctttcttggttacagcgggaatttcttgcgggacgctatctggacgagggtctggcgcgctaggattctttttcctcagcaaattattccagcgctgcagaatatcttcgtatccccgatatacgtcgtccgcgtgtcgtgtattggtgtctgcgatcggataaaggtgttcgccttgaaatccagtctgatactgttctgttgtccagcatttcgacggtaaaaagttaagctgcgacccgatctttaaacagcgatcgttaacttctagagttacgagagctgtttgcgcaaatctcccgattttcagggtcagcaagtattggccagagagcgcagcagtgggggagaatatagtcagtcccgcgccatttcgcgatacaagggtgctaggaacatagtccactgcccacatctgtgcagattgaacggcgcattcagatagcagttgtacgtcgccacattccctgtactcttttctatagattggacagtacttgtcctcgccgtcgtcgcccttaatcacgtagaaccagacgacggaggcctcgaaagggccccccttctctttttctttggccgccgatatcatgtcgtccacgttagaaatcgggttgagctcgacaacgtcgcagcctcttgataccctagtgaggtatctgttatacgggccaaccgccggtatggttagcgcgtcgagcgcgcgacggcctaaaatgtagtcgtacgtgacggcggcggtgctctggctagcgaaggaagaaagcagtacgatagtccaaaaagcattcctcaaaaataaatggcggtccatagcgttgcgtacaaagcagatatgctcccgcataatcctgacacaagtccagaaaagagtgaatacagctgcgcctgagcagcaccgttttccaccgcaatccatgtgtttgttaagcacctctcctttcgcgtagtaacgcgagtgccgtctgagatgaggacggtgcattcgtatatattgcctccccggccagaaatccacgcctcgcctgctctcgcgctgctcttccacactgtactttggccagcggtatgcgaaacaacggtcgtggccgtcaaatattccggcagtgaaacattattaaggctccattcgaatctcggaacaacgccggacggcagagttattgtgcagtatgccgtttgcggatcagaggtaaagtataactctggcgcgatatctttttccctcgctataagagacgtgtcgaaaagacagtaaggttccggagaatggctcgtgcacgacaggcacattagctggaccgatgttcttccatcggttactctgtagtacagctgtttctgccatttctcattactgttaaaaaccccggcgggactgttcccagaaatttcatccattacatctacgaggtctactttccaattagtttctaccctatagggagatttgacggtggaaacgcaagtcgccgttacttcgccatcgtttgaaaacttcacctctacaattttgacgtccaataggggcgtctgcgactctgccgtcgacgggggatccggcctaggcggccataacttcgtatagcatacattatacgaagttatttaattaaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttggtaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaatctagagggcccttcgaaggtaagcctatccctaaccctctcctcggtctcgattctacgcgtaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacttaattaaataacttcgtatagcatacattatacgaagttatccggtgatgcggcactcgatctcaatcactagtgaattgcgcgttcaaaaaaaacacaggcggggtacgataaatttacgcggccgcgctatgtttactttatacatcagaggtcatcgtcaacctgcgcaaaatttccgttaccgtaaccgtgccgccacgatgcttgcgcacggcttttgggcgtggaccggtcggtgcctccaaaaggcgttcggggggcgtttcggggaccgtactgggagatccgacagccacggcgttgcacatatctgccggaatcgccaatcccgtcgtagaagcacaaccattcctttcaatcgaaaaagtggcagggagggttgcggctcggtccgatgcgggcgaaggctccgcatctgtgcgggtcccatttgacgtagatgccgtagtcggtgtcggggagcggagataagttagcgagcactgagcgggaggcggggagtcttgagtgaagtgcatagtgaagatggactgtccattagaggcaggcgcttcactggtctcgcccccgtcctctacccacgcacgcttcgattgctggggcgagtcttgcaagcatctaacgactgagtcacctcccttagccgcgggttggtaggtgaccgtcgacttaactcgtgcgtgtttgaaccagagcgccaccgtggattccgtgtcagcccacgtgcacgagttcatggtcggaaatagctcccccaggaagcactggaaccgtttctgttgccggagagcacgtctcaatgttgagttagccatgccgccctgcagccataccgcatacccgttaaagaccatgttgaggatatattgacagcggtaattcaaaagaccaaccaacgccacaatagcgactacaggccgcgatacttcactttctgggctgcttcgccacgcgcagcacgtccacaaagcgcccatgtgaacaagaggggctaaaacggttccgataaaatggcataacatcgtagtgtcggcccagctttccgatggtagggaactcacggcttcggcaagggccaaaaatacggtatcaaagtcgctcggggcccgagggccgaagacgttagggcacgcgcgcagatctaacacgtccattagccacaccgcccacgtatacaacgtccttacataactcagcaatagttgcaagcgtatcgacgtatcggcactaggcgccgttacatcatcgggtctcatgtagtaggcgtatttttgaataagctctgtcccgtcccgaatctctcgccaacatctgagatacagtgcattatctttcgcgagttggaacggtttcttgaccaaggcgttacgattaatgatagggtaaaagagcaatgctgcttcacgtctagtcggatcgcaggtctcgggcgaaccggcacggcatccatcgcgtctcatctctaaataattcatgtaagaggcctgataacacctcttgaccgacgcacgagtcagcttcttttttttcatacggcgcgcaatgcgcgcgcggtagggcctcgtatactcttccgaggcatcccctaacgcgaggtagacgacgatacattccggaactttgttagaaggagcgtcgcgcaacagcgtttgtcgcaaagcagagagaaatcctgaggggagcacttctacgagcgcgtcttcttgagctcggatacccgaaagagatgtacccgttgtttccgatagctgacacgggtactcctggacgcgcgtcggcgaacctcgtgaccgggaatttaacgccaacgaatccgtctccggctcgggagaagttggcgtaaacaactccggcgacatgctagcgcaagcatatcggtccatcggaatctatacagattaggcgcagtacggaaaggccgacttttgggacgcgaagtggccagaagcatcgctttccttagcacaactattcttaaatgcgatgcttactcagggcggattgatagtcccgcccatacggcgcgtcaccacgatctgcacgccgctccgtgcgctttttttttaccggtccgtttttttgaagatcgcctccttcgcatcttctaacacatcctgcagcgaggctagcgtgccgagaaggttatacccgctcggaggcggtactagctttagagcttccaactctccattcttctcctctccacgaatcgctgtcgcaatgccgtcgggcgggtctcctcgctcaaattccaattctaaatactccatagcgtcgtcgcggtcggctatatattcatctacgctaacaggtcgatacaagcctttacatacgtagcacaggtggcggtatagcttaaacgtttccgaccaaacgtctacagcgaggtcgtggtacatggcggcgatcgtgaggtgcgcgacgccgatattcaaatgccctagcagacgttgcagaacaatggtagtggctaccacggttgcggttaaggtgtctcccgactcgatatctctctcattcgccgaggtgctgcgcgatacgaactcgttcataagctccgtaagcgcagatctagtagcgacataagccccgacgaaagtctcccctagcggcgcgcccccggtaccataagaagctgattccaatctccccaggcacattccttccgcataaagaacatcgaggctctccattgggagctttttatgaccacggcctagcagtcgcgcccacgcgcgaacacgattagctttgaaacggtgaagcattcgacccgacgaaacatacaggaactgcgcggcgatactagcagccacacatcccacagtaacgcacgacgatagcatttcaagttcttctttcgtcacagacaccgtgtcagacgacactctcgacaataaaaacacttctgcccgtagcatagcggcagcggcatagcgcactgcacttttacacttcgatcccaaaatgcaacggagttctggccagtacgccagagagccgtaggaagcacgtaaaattgcagcagcggggcccttcgccttacggatagcgccgccttcaaacattttagcgtcacccgtaggaacgcgtggcaaagacgacaataatttggcgcgaccgaatttggaaaagccccctttatgtatcctcaccgctagctccaaagccgaggtaattaagaaaataatagcgtctttctgattcagctcgccagacactacggcactcctcagggcatctatcccgaggcagagaataagcgcgtgtgcttgcttcgccgtccgtttccaggcgagagcgccttttggtggcgcggacgtatacatatcccccttggcatagtctgatctgctgtcagaatgccaaagtggaccgtccccgaaagtattgccccgggtatgtagtaatttgtcttctcgtatagcctcgactcgaggcacgggttccaacagccgccgcaacggaatgaacgtgccaaggctctcgataaacgtcggactcgtgccttcgaccttgatgctattgagatcgggttcggccgataaaggggaagggaccgtgtaagcagatacgacccgctcgtaaggccgtaaatcgtcatcatctcccgaaaagctgtcgcttcccagagattgactcttttctctagacgatgcacccgagcctttacttatccagttctgttttaagtcagacggcgcacgctccaagctgctgtcgcgattaaatgaggttcgatcctcatgaccgccggctctcggtcctcgcctgcgtgacgatccgcggcgtcgtccgcgcacgcgcccagaccgagccgcatgtgtgtattccccccctctagatgatcttcctctaaactggacccatcttctggatcgatggcgaccttcagagccattcgagcctatcgaagaccggccagaacccctagaataatgcgtgcgcacgctagcgtttcgatgtcgccgtctagatgacgacctccgacgtctagacctaggtctcgacctcgatgaggcgtctgtcatgtcgcgcgacgcatcccggcctgaacgatccgaagagcgtccctcccgatctctgcgatagtgcgtatgagcactagcgttgcgatgacgacgcctagacgaagaccttcgccgtttagaccgaggtttagatctcgacgatgcgtctatcgcatcacgcggtacatcccgtcccgtatgctccaaagggcgtctatcccgaaaagtatctcgaatgtagccaataaacccttgtccgttgcgacgactcgtagatccggcagagctcctatatccatcagtctctaggcgatcgtacgtatcgtcgtagttcgtctctgatggtcccacgtgtatgcttgccatgttatagggacttcgcgataatcggacacgcgttttagttccgcgcgttacataatctcggaccgaaccggttctctgtcgctgctcttgaccgacatccccatgacggtgtagagccagcattcgccttcccgtcacaactcaccggcaaagtacggcggccgtccatcgccgtctcattttatacggtgcctaatcgaacggcggaaccgtagctatatcgaccgcgttccattgagaagggggcgcgaggaacggtaacgaagtaaatataataaaatcatttattagctgtcgcttttacgtacaacattgttttaactacaaaatcgtaccgtcgcatcaagtattacatcaccgtttaccgttcgcggcttacattgtgcgagcagcagcgatatcctcggcaatcgcgggcccgggatgtgtagaatcccgcaacatcgctttcacgatagtcccatggccacacgacgggccggccttcccagcgcggccgctctctccccgcgctgatgatcgcggtcttggagggtgcatgagagagtacacttccagctttgatttgatgcactggaatagatacgcggatgccctaggcgcgtttgctaaaaatgcaggcggggctgtcaaaggcataccccgctcttccactaactcgcatcgcatcaccggcagtccgagttcggaccgtacgtaattttgtgttcttaattcggcggcggttaacgcacgcccttcaactatcacaacgccgtggttaaaaataaccggttgaaataaacactgaaagtgtcgtaattggtgccaatcgcaccgcaggtgtgcaaataagttttgccttttcctctgactggcttcgagtcgccgcgatacatctcttgtaaccgaaaggtataaatgcatatacagaagtcttgcgaaccttgccgcttcccggtaatacgccccggcgatagatcgccggggcgtctctgacctgccgacgcacatatcgcatcgcgagggttcgttcgctccctgcctaagataacatgccaaagcacgacaataaccgcaaagtagagtgacataggatttttctctagcttccaattccatcgaaaagaatttttgaatctccgtaacataaacaggcaagccgtcctttgttaatgggggccgcgggacttccatcccgcaatgttcgtttagatttatcgccgtatatgcccatttctcttcggacgccgcatctaggacttcgctaggagagacggacagtagggttgcatgttcgtataagtgcccattaatcggaaagcacgagaacaagtctacgtttagtttttccagccgagataacagggacgggccctctgtaaaatccagttcgtgcaagagcctgttgtacaagcggttcggaggattcggatttggggacggaagcgaaattttgatcgaaaatggagcactcaaagagaacgaggcagattgctccgcgcatctcgtttgagagcaaagagtttcgctaaagctttcaatgccgcggaggatgtccgaatccaaacagtccgtcattccgtttacgggcgcttcgatctcggcggataagtccgtactgtcgcggcgagcatctcgactccccggtcccattctccgcgtcgccatccatctgcttagtagcgcccgccccactaccgatactttatgtgacgctattcactctcgctactatagttaccacgggaacttgagtagtggcgacgtgaagtcgtcggagcgcgaccgggggtttttgagcgacgatctctcttatctaccggagtgctctcgtcaccgtcgcgttttccatattgggatctggacttagggtttcccatatccggcgacagtccggactcctccgataattttcgcgtacatgcctcagcttcatccaataggtttgccccttcttgaatcgtgatcttgattatagccctggcgaggaattcctcgagctccgcattggtcctcggggcgttccgacgccaaagggaaagcgctcccctatatgcatggtactgggccacagcagctacggctccgcagaatatacgctcgttatagacgagcgtgtttgatcgccaggtactagttgctgacgccggagtcgtactaaaggcaaatttccctttttctattgccctggctccgggtttggcacgaactttggaggacagcgactcccctctttgggtttccgatgaggaatcttttctttcgatctttacagatctgcgtctttgtaatgaatgagacgggggggagatccggtccggcgactcgttcttggacgaatctcgtcgagcgcgggtcgacgatatatgggcactattatccggtgacgtgcgcatagttgagcgacgtcgactcgacttacgtctatccgaatctcccattgtatctcgtattaggcagccgattacagacgcgacgggccgttacgtttcaccgtgttgcgtctccgacactgatcaagctgttcacggcaatgacattcttatacgggaacagtagcgcccacgcccacacgatcttaccagccgtcatcgaacatacttgccgtgaatagtcggaagcatgcatggtacgacccggccaagagggcggagattaccgccaccagacctagataaaaaaggaccgagaagccagaagaaaaggctatagacacgcctacggcggaacacgtagattcccagaaatttcctgccacggcgatcggccttcccgaatcgatcgaagtagctcgcgactccacgagggacgcaattacgcaaattaacactttacagaccacatgatggatgtcggacaaacccatccctgcggtaacgctttggaaaagatgtcctcgcacgcgtcgggggctccgtggcgcatgcagttctccgtcgatgaagcgatatatgcgaggaacccagaaggttggacctgttatatagaagaacgcgacccgcgctgtcttcgcgttatcaacgactgtgcgatctcgttgcccaaacgcgatgttaagcggaagtatgaaatatgtgcgttagatctaggtgtacgagtggcagttcctcggaattatgtcgttgtgctggcgaaattgacggacccggatccaacgtctcggggcgtacccgtaatccgcgttgccaatggactaatagattctggatacagggggaacgttcgagtggtacttttgtacgaagcagcttgcaccattcctaaaaacgggctggttatacgtctggcgctcgtgcagttggcctatccggatttcaacagtcgcgtgctttttgacctcgctgatatcacgccccacttggattgcgggcctaacttttcgatgtcgattgcaaccgctgctaaatcgcacagcgctcaggctcgaccgctattgccccctggcggcgagaaactatggccgggaaccgggtgtcgggcactcgtctgtttgtacagcgatcgcgtgtctcgggcaactcattataacactttagacagcaatgtcatatttgccgtaaggtacaatgattctacgaccgttatcggcttaaaagatgtcccgaagtatgtgcataaaacatttgtacggttttatacatccggtcaatttgcaacgttcgttcctttttacgagacatttaatacaaagcggcacgaagatgcggcttacgatatattcgctccgagcgacattgtattggaatcaatgtcttctgtaactatcgcgatacagcagcgatatgcatgtgcggataagtcaatggttccttggatcttcggacggtcgtccatgaatttgcgcgggttgattatttccccatctaggtggatgcccgattcgtggttaacgctgactttatgcaacttaacggaagcaaaagcgaccattaaacgcggagataggatcgcccagctgttgttagtcaatcaggaagccgctgcgttgcttccaacggaaggcggcacggctgcgctgttccctacagtaggtaaatgccgtcgtcccgcagcgtccgcggaagctaagtggagggaaacggcagcattcgatacggaatcgggcaggagcgagagagagtgtgccggcttcgggtcgagcgggcaataatgtatagttgcgcacgattacatacaaaacaataaacacgaacaccacgctgcgttctggacaatcagtttattcagttacacagtccggtaacatgccctcgttgactccacatgtcttagcccttctaccgcttcccttacttacatcacatgacgttgcacatgccgcttgctcggcttcagagtgcggcggcgaaggtagccctcccacccgaccgtaaatatctgctccactttcgtccccgcagttacgggggtcagtagcttccgatagctctaagttttccgtttcgggacacgcggccaacgcttcgagcgagcaatcatttggggaagattttaagcctaacgctctttccactagagcgatatcattcatagcagtctctgtagcagcagttatttgtatcgcgtgttctacgaaggcatccgttcgtcccgtgccgacagacatgtagatctgcaagagggcggcggcacacgtgtccaccattcgctgcgcatttttgcgatgggtctcgacgaccgcgtcgagcccaggggttccttgtcccgaaacatgacgagataggcaatcgagattacggagacacgcactgtacattctagccaacgactggccacgaaccagttttcgcactccgtcggcagacaatatcgccatttctaatgtgatgggcgtggggagcataagattgacggcttgtaccgcctccctgaaacgatgcataactctgtcggaggaagacgaggtagacagtgctgtgtattccggctgaatttttctagagcgccttcttaacccggcgtgcattgtggccaaatcttctattatgtccgatataccggaggatgccgaccctgggatcaaagttttgtttgccgttgatggttgcgccgtctcgttctcccttgcacttcttacgggtcaggtcccatctatcaatcccgtctacgttatcagccactgggatccgggcaatcgtttgttagatgtcctttgccaccgcgcagacgatcgcgactgcggaagaataccgaatgaacgaggagatttaaacgcggtctccgaccctctaaaagtagagttttgccttctcagtcaaatgacacgcggtttgggcggcgccgatttaaaattgcggacgcgagcgatattcgtgtgccggtttacttcgcattccgagattaactccatcgtggcttctatagcttccggagcgcctattcaaacagacttattaatagccaccctctccgaatatgacacatttcgcctacatgatgacttcaacatcgccctccacatctctctcgcctgtttatcgcaaaagcgccgcaatgggaaagagccggcaaaatcaccggatcgaaatctgctatcgattatggcgggaaccttttctggaggtcggcgcggtctagccgggctgtatttacaatacgagcaaaaagtcaccgcggcctaccgacgtgtatatggggggtcgacgacgacagcgttctggtacgtgtctaaatttggaccggaagaaaagagcctggtcttggcgctacgttattaccttttgcaagctcaggccgaacctactgggattgctacgggttacgatttacaggccataaaagatatctgcgacacgtacgctgtacccgtagaggccaatcctaccgggttttcgacggcagacttgacatcgtttgccagattatcgcgtttctgttgcgtgagcaattatgccaacggtcccgtagctagggcgtttcccctatacgtggaacacagaattgcagccgacgtgacagaagtggatgcattgaaagagtatatagaaagagaccggtccgggttaaagatttcggatttggaatttgtcaaatatatttacttggcttacttcgagtgctacaatcgtgctcaattaagacgtcatttgcgagacgtgaccgtgcgttgtcccgaagaagatgtctacaaacgctcgtctctggggaaacacgcagtcgataatttctttacgcatgtgagatccagactaaacgtgaacgatcacatagcatgtaacgtatctccggatcaagtggaaatgggaaacgttttgacccgagcattttgtagggccaggacctatccaccgagtaccatggaaagcgatgcgcgtttcaccgggatttgcgaaccctcgtcggtgattataaagcgtctggatgccctagaatcgacattacacaaatacggatggccgcgcgcacggtctgaaacagttaacatgatgtcagagtgcgcgaatttgcccatcgcttcatctgccgatagtcttaggccacccggcctgccgctagaacatccaggcactcattgccggggtggtccaatgatcgtaaagcgcctactagcgctagtatccgcagatgcacgtgtcggggacataggaccgacaaacatgctcaccggcattcgggaatcggccgtcaagggccctcttccgatttaccggataggcatgtccaaaggcaaacaagcgtttgccgtgatggtggccgattgttgggacaaaatcatcccgtctccgggaattgtgaaagcccatctctctaaactcggcagatccggtagagcccccgaagacgatgtgatcgcccgagatattttttttacatcagaacttgagcgagtcacgggccatgctgcggaactgccgtactttacctgcggccctgccgaagaacaacagtacataaatcgcaacgaagtgttcaatgacaatcttattgtggggaacataatcctggatgtcgatgtgcacttacgaacccccgtacccgtcaaacttttgcatgtggcaatgagaggttttaggaccggtgcgctcaaagcgttgtctctattacttccaaaagcaaaaatagatcacggctcgtacccgtgctacttttacaaaacctcgtgcaagaaatctcgagtcgtgcacgtaaaacattggatgtcgtctactaccgacttcgctctcgactgcgacggtcccgccgtcgaaagtgcagactgcgaactagaaatgggcttcgatgacccgttacttatggatcaaattgatgattccatcagtagatgtgagtcagatgcatcaagtttgccgtcggacgccgatctgccttgtaactgtcacgaaaaaataggattgcgggtctgcattccggtgccgcccccgtatctactcgtaggtagcagaacaatgagcggtctggctagggtactgcaacaatcggttctgttagaacgtagtttcgtagaacctatcggttcgtatctcaaaaactatgatatagttgatagcggagtatatggtcacggtcgcagcttgcggcttcctttttttggcaagatagacgagaccgggcttatatcaggccgcctgcttccgttttgcgtgataccggagcgctgcggtgacgcagaacagttcgttctgtctcatttacagcctaaaacctttcacttccacagtcccatgcccgaagaagatcacgcgtctgtagttctgaagggcctaggcggagagtatgccggattctttgaaaaaaaaatcacgatcaatagagatacgtttttcggaatcagattatccttagcggtagctctgaaagccaggggggttgacattaacgactctgcggcaatcgtatcattcgtaacggagcacattttagatgacataattcagtacatgcatgaccacatacccgatcacgctgcggaatataatcacgtttctgtttcgtgctgcgtcattagaccagattggatcctcttgcagctaatggccaataaaacattgggacgcgctcacgggtttacgtgcgtgaggtttaagcatacaagaacgactcgaatgagttcgcgttcgtatttgtctttaaacatcgacgcacatggtaggttgtgcgcgtgtgtgattcagcagtgttttgcggccaagtgtggaaacaataaactccgtactctttttacggtggatgtcgattcgaaatgccaggcagaacatcgatagccctttcgggaattatactctgcatctcgacatacgccatcgctttggtgatctacacgacgatgatagctaaacacggttctgggtgcatctatgccgtcctggtagacagcgatcatcgcgatgccaaaaattttacatgggagccatacaattctacactggtatacacgccgctggggaataaattaccattggacggaggatttggcggttttagcgatgtatgtaacacatatctgatcaacgcgacggatttattcggacgcgcgtctcacgcgtccgccaagtcgaaaatccgttcggtggtaggaacgcgcaattgcgcagcctacttttggaagacgcatatacaagccttgaccttttccctaagttcgtacattatgttttgcgtcattagagaatggagacgcatgtttggggtggtgcgatctgaaaacgacagaataccgccgacgacgtacacgaagaattatactgccagggtaatcgctaacggattgctaaaaacggtatatactagaatgtctgaatttatgtgcgagattactatatacaaaaattctatgtgcagaatatttacagacgaccctatctcgtttatcttacgtcaccctttggctgcgattctccttataaccgagcggctcataaggctcggcgcacagtgtctgtgtgtactaacggtatcgattttttttgtaccgtgtaaaatagttttatcgaaatggttcttgtctatcaccggagttttcttaggaatcgttatttgcaccgagatgggcctgctgatagacccgggaccggctgaaaaacctgtcatgtttgcagaagttgccccagcccccaaaacccagcagaacggcgtggctgtcccgttcggtgcacacgctgtatgttccaattgctgcgcctccataatctccagcatagtcatcaaagttctgtacgtgttattcatggttaccctcatcgttaccctcgtgcgatatgaacgagcgctccagattgccctgttcgggcgtgcgtacctaccctaaaacattagtggccaagcctcctatttgcatcgcgcggatgtgacacgctaaccgcgagaccttataaatggttccaatgagtcattcgcccctcgggtgtacgcggtattctacagcagcgtattagataaactacacgggtttgccgtcgcgcctcaaggaaaatgtcagtgggagctttctctcgtgattgggacgatataatgagtttgtcagactacgattttacagaggaagaatccttagatgaaagcggcgaactgaaagaattcaagaacacgtccgcgttgaatgctattgagacagcccgcgacgcaattgaaagatcagccaattcaaacccccccatcgaagaaccgtcgttcatctccaaatctcatgcaggcgagacctcggcctcgaaatatagaagcttgcccctcgacatcgaaaaggcagaacggtgtgatgacactcgaggctacaacgtgagttcgggaaaacgaatgcgtttggcagtttcggccactgttgacctgtgcgagtctgagatcgaacggcaatgtctgaatacggaaacgcgggaccgtgcacggtcccccaaacattttgcatcccattatgaaatcgccgccaaaatacacgatcttcccagatctacgggaaaaaggcaacggcatcgcacgttagattctcgctcacgacgccacttagcgggagagcatcggcggcggggagctcatgacgaggaaagcagacacttttccctcagaatgcgtgaccctcattcagcacccggcaagagcccgctgtcgaaaaggcgcagtcccgttaggctccgtaacctctctgtgcaggaggaacttaacgcgatgctacaacgagagaaactgaagctcgacatgatttcgagagagcgcaatttccgcacttctagcaaaaaccgctgggcctcagtactggcattctcctgtaccggaaaaagtggggcatacgggtctcagataacgtggcaatatttgcttcaagagggaccggagcttagaaagacgttcgaaaatagacctagaacctcattgctggcgtctgcggcgcgcgaagctgtgttgcggggcgaaaacttagttgcggcattggagagcgccgaggaaaccctggcatggctgaaattacactctgttctaaaactgcgtttaatgaaccatgaccctattttcaggacggcgggtgccgtcttagataatctcaagctgaaactcgcacccataatgatgtgtagaaatggtacagacaaacggtcgttaggagacatgctgagaagatccgccacggacgatatcgccgattcattgaccttatgcttaattttgctatcgcgtattcatcgcatgatgatgtatcgcgtgtcgggtagaaaagatagttccatgatagatcctcggggatacatgagagagtatactcctggtgaatgtatggcgggtatattgcattacgtagacgcgcatgcaaaaacgtgttccgacagagcgtgcaatttatatattagctgtacccttatgcctgtttacgtacacggcaggtactttcgatgcaattccgcgtttgatatgtaacctactacagacgggcaattttgtattcttcaatagctttatttgatatccattaaacttaaataaagacaccgatattcaattggacatgaacagcgtgcgttttattttacacttagcctgtgtgctttcgacaccgagtaggaaaacgaaggacctgaaattgcacgcacgaccgaaggaaataagccatcgcaatcgcatttgaaatccaagtaggcaaattcaggagaacctatcacttcattgaacaagttctcgagtattcttatgaatgataagcactggagcccgccagggcgatcgcagacacaactaattaacatgccgtgagtgctgaagttctctctcatggcagattcgcataagtaaatagtcttccttcgagttcctatctccgtgaatctgcgggggttcatcagaagcgcaggtttgatttccgacgtgtgattagaatgaaattgtcgaaagacagtctttagagtcattggcatgtctgtcagtactatggacacttccttgcggcagcgatcggtaaggaaccacagtagttccttaggtagtatgtttctacctaggaaccacggtgttcccacggccaaaaaccaagcgtggtcaaacgatccggtgctcggagaagaacgctgcgtatccgctacccaaagcagtatcctttcgcagatagacgacgttgccgtgaccattctccctttccaacctcccgtcagtacactgtttattgggcccccggcgtgcgtgaggagtaccggtctagcgactattccataaacgttagtcggtgagagttctctcggggtgagccacattgggaagcccgtctgggttggagcgtccgatgtagagtcgtaattggcgcagcgctgaccctgcggtctacaatgcatggtcatgctagacgggacaactagtcgcccggtgcatttttcattacggccatcccttacgtccacgtaccacgtgccgtgagtgtgtaggtaacacgtagtgggcgtggaaaaacttatataacacccggcagaaaccacgtgcgcccagcggtggcagatcctcagttctacagtgtccaatggcggaaagtacagctgaaccgtcagcttcaccggtacgaattccgtacgtttggcaagtgatcgctccgttagcaattgacgtgccgtccgcctctactcaactagctacgggcgaacatgtgtcatgtgccgcatccgttattcctcgttcgtacgtcatacgggcagcgtgtaaatcgtcgacgactttccacgcgttcttctttggattggcgacggatccgtctgagaacatgtcccaatgcggtgcctcgtatatcgcgtatagaatgaacaagaagttacggactggtcgattgacaggcgaccaatgcgagtcgcctttttctcatgcgacgatcatcgactcactggatgaaaactacagcatggctatagagggactgtgttttcattgccactgcgaaaataagttttcgctcgagtgttggagatcggcttttagcgctgccgaaaaaatcgcatcgcagtgcagagctattcgcgagtacggacactgaataaaaacgaatcatgatttgatctaccatttcagcatttattggtttatacattctcgggttcgtatgtatacaaaatcttatggcaacccgcgataacaattcatttacgcataccaattgcgagagctaggggcgcaccctcaggttcgcctacgccggtatagcgttgagatctaatacgggagtagtgattttgcaggaatgtaagtggtagtaacacctaaagaaaaccacatactaacgctctactgttcactcgtatctacgtgcagtgaggttcccgcatatgtttgcgcgtcatcaatcgctctcgccagtatcgccacaatgcgtttttcgcgcgcgggtattgggacgcagtgtaagtggaatagcattccgcaggcaaaaaagttgtttgtcatgcaagcatccatcaagtagcaatcacatagtgggaccagacgcctcaaagcgacgtagtggggggaaccctcttcccattgcaaccactttcgaaatctgtaggtatatgctgccagccagcgccttgttctgacggttattaccctgaaccccttaaatgggaagaagaatccaaggtaccaatcgttggcgactggcccgtgcggacaacgggttaaggatgtgacaaactgtgtttgcgtgggtacgtttacgatgtatttcgaatcccgcacgacgcattcctcccagtgagatagtagtatcccataattcatgcatctgactaccttgggggtgagacacgctgtaatatgaggcgtcgcttgtaaaacgcacctgtatggaaccgttccgagttcggggattgattctatgatagcaagtctacttattccggaaaccgccatgacatcgcacaaaggaagcagttggttaattgcatgaatcagaatgtttgtttccagcacggcacctccaaaggaaaataatgtttcgatgcacgttcgtgccccgttctctgtattacagcttactagcgcaaggctgaggacaaaaacgagttcgggctttgtatgttcgagcggaacaccaatgcgacataccgtatcgcttaagtttttcataaaagtggatcttgcacgtttgccagatctgctccaatcggccgaaaaaaatttgcgcacaatcggatgcatgtctgtgcctacaaataccatgaaacataattcttgtgctggacccccatccccgctatctatatctacattgtctgacatgtgttgtgccgacaacaaacggtgtcttgtatccccatcaatccagcgctttctgaggtttacgggctttaggatggacacatcaccgcatttcggcacgcataacgcgggcatgtctgaacgggcaacgattctctctgtgagcagatcgagacggccgtgacgcacaccacgtgccggtacattaggcacgactgtagcaaaaggatggtagcgatggagccagcctaccgacagtcccgcaaaaaatcttatcggcggaatgtctcttttaaggggtagtgtgttacgaaccgatgaattcaatttctctgtccaaccacttatcgcttccgcaacagaaaaatcgtttctaagttgcgaatatgtttctaccacccacttgagatcgctgcgaagggcttccgacatttttttagcgtattcctcatctccatcacaatcacagtcgtgtctttcatttgcaagtgtgggcgcgcagatgtctacgcgacgacttaaccgagacactgtttctctagtgtaccggtaacatggactggcgcccgctctgaccgttagcatgcgtttggatgcaaccgaggttagataaacgtctggagaactgcccaattctttgctttcactggcacatatccaaccgtatgtatcctctgtctgtcctgccgcctcaaagttaccggggagaggtccgggactcgctagacagaagtcgatttgggaaaattctgtgtcattgttgtagggactgtgcggcctatctaccatagttgcagaatcgtgcattagaatttcagcgagcatggaatcgatacgttcgtcggcacccgcatatacggcacctattcctattcgcgtacaagagtcatcttctacatcaagcttccagaacgttgtcaggtattcgccataggctgcaaagtctgcatctgtggttcttcttacaaattcaatctccgggttccaacgtccacgtcccatacataggttgcgcaacgtgatcgagtacgccaacgtattgaaatcatttatgctagatgcttcgctattatcttcgaacaaaattatcgtatacaatttcgattgatgcatcgatcgaaggactgacaaatctgtcgcatatgtctcctcggggagaggtgtgacggtgataggctcgtccctacgttcgaaccggataaggcctactgtagcggtggtttcagtagtcctgatgcatcgtaaaattgtggcctcggttctaattttcccgagtaaggcccacggaggtccgcaattactattacacagggcctggattacggaggaagtgccagttggtgcacaccgaaactctggaaaccattccttggacggaataggagggtggaatttttgtcgtttagtccactccatctgttcgtacatggaaaatcgtgttaattcctgatcgtcgaaatgtgctaatggagctatagtgctgcgttcggctggtgcggaacctatagacacgacatattttggttgcacgtgcagttctctgagctgattaggaaataatactgcgtttgatgatagcaaagacctttcgggatcgagctccggagtgcagtgcgaagcgtgaacaattctacttttcttccgagacggtgtgaagcaaaacatcttgacgatgctacgttctatggcattctgcaacaataaagtatcaaattattttgacattatcatctatagtatgagcggtgtgttatataagaggacgaaacacttgtgaagtagacacgttttattcaggaactcacattttcactactacgctgttgtgagcagagagataagcgcggcggaaaaaacagtcacaaatactactgttaatataatgatcgcagccgcatcctgtcgggcattaaacaaccaatcctcttcatcattagtttccgaagagctagtctcataaggcggcggaggagagtcgtaggtaggaggtggtccatttgaggcttcatacggaggcaaatatgcagcgtcgcattgaccgtcccccagttgtaattcgaaatgttcatataccgattccccgggagcgtctaaaaatggttgctcctcatgtaacgcttgcgcttcgctcgtcagaccgcggtctagctctgcgctcgtaagttcggtttgcggtcggtcgctatccattttccctcgcccgcagtaactgtgtcgatggttcactactctcgaaggagttaaattgcctactttctcctcgaatctcgaatgtggctatgcagcatcagggtcattagcgtcagtattttcctctttggagtctatggctctaccccaaatacctcccgcgattgctcctgtgcataaggccataaacaggccggccctctgccaacccgttgaatccaccttcactgctctgccaattagtattcctgcaaaaaatgccatgcatgatcccattactaatgatcttgcggaccgaataagcgtgattaccattaaggagcgcattgtagcattctcagattccacagataaaacagtacgaggtactgtaggagcaaggcgctgacctacgaggttttgttgcacctttcccgctcctttttctgctatcatcagtaagttaatggactgcacgatttcgctttcggcccggaggaggcggcgggcatcttgtaccgcgcgctcggcgcgccggagcaggcgcgcgtgcgcctcgtccgcgtccgcgcccgcgtccgcgcccgggtcgtcgcccgggtcgtcgcccgggtcggcgcccgggtcgtcgcccgcgcccgcgcccgcgtcgtcgcccgggtcgtcgcccgggtcgtcgcccgggtccgcgcccggtccgcgccctccggcgtcgttctctccggcgtccgggtcgccccctccgtccccggctccgctctcgcgctccgcatccctctcggcgtccggaggggcgcgcggatcagcggtcgggtcgcgatcgcgtccgtcggatcggcgccttttcccccgccgcatcgcgttccgccgggccggtcggacgggagaagaagggggagggggggaaggaggagaggggggagggagggtagccggccggcctgcagttcgggaagagcgggggaggcgccgtccgaggccgccggggaggaggttgtggggggcgggaggatgtgtgggggaagggaagggggagacggccgaaacctacgcgttcgccgcggcgtccgatccgggatcgctcccgacggggctctcgttcggcgatcgcttatcctctgccgccaccttgcgtccgttcgcgggaagcgccggaccggcgctctaagcggagatccggcgcctccgcttcttatgaccgggccggtcgtgagggcgtaacgatcacgtgatgcaatgcaaacgagcggggcgaacgcgtcagcgttcgcaccgcgaaccaatataagattatatatataatatattattggcgcaaggtgcgaacgcccgtccgggccaatcgggaagcgggatcctatgccacgtgttcgtgtccggccgcggcccgcgccgggggctagaaacgccgcccccctcccacgggggcggattcggggacctccggcctacaaatacgcgagcggaggtccggcggggaccgtcgttccgctggccggcccgccgtccgaaagcgcgggaccgcggtaataaagcgcccgccgtcgcggatcggattttctggtcgttcttttaccgccgggcgaaccgcgcggcgaacgaacccgtcccgttgggatcgcaggcggccgggaagcgatcgcgcgccgtcccgagaacgtcgtctacggctcgcgttcgcgggggtcgccgacgggtggaagggggatgggtaccgagggcatcgaactggccgagctcggcatctccgccttcgggccgcgaccctcgcggcgtccggaaccgtcggacgtcgagggaggacgccccatcgttctcgtccgcggatcgtcccgatccctcgcacgagaacgagatccgaccccgcgtcggcgacgcggccgaacgccgctcgcggaacacggtcgcgggtcgccccccgactttccccccggccccgcacccgcggcgaggtcggaacctcgggaatcgattgaaaacgggccggtcgagataggaccgctctctcgttcggaagcggagcaataaagccgttcggcgtgagctcgggatgagtctcggacgcgcgtcggtccgtttctgcccttgcggcgctctacgaaagaacccgatgaggccgcgttctgttcgggagcggtcccgagctgtagggatcggctcagtagtaactcgtctcgggtttcgatcgagttctagcgaaccccgaaaggggggtacgaggaagcttgcggcctgccgcaaaaagactccgaggagaatagcttatccgcgatacgccgccccctcaaccgttcagcactcacttcggcgtcagttccgaagtgactttgtctggccggctcggcgcgagccggcctcggagagaacgcgtacatagcgatcgtgggctgggcaacgagataggagtagagggatggggaaaaagtgaagtcccgcgctggctctggacgaggcggaacgaaatgggggaggggacggcctctcgaacgagagcgggggtggggcatggtcggtggaggggtgtgggaaacgccgcgacgccgcggcccgtccatgtggtaatgcggggaatagagttccctgacggggaggagttgtcagctcaccggtcccgtgatcaacgcatatgccacatatatgcaaccccgcgaccctctcctcacgaacagggtagagggtctcgctttgttgcacacacaagcacactcacttttgcggcgacaatgaaaatcgtgagcccagaccaattgcccctatatgtgttaacggcctccgacggaacaacggagttcagtattcgagattggtcgctatgggatcgggatccggaatcccgtgcaggtacgcaccgcgggctccgtcaaacggaacgctctcttttggagcgatgtcgtttgggtccgggcccgagtagggttcggccggctatttccctcccccccccccccccaagcccgtgcgggaccgaggttgagtgggaaggtctcgcctgccggatcgggggggaggggaaaagacgtttgcgttatccggaatcgagccggaccgttttacgtttcagagttcgaacacgctctcacgagctgcagccaccggctcaagccctcagaccgcgtccgcgccccgggccagcctagcgtcgcaaacgtctggaagagtctgtggagtttggtttcgagggccgtgcggggaaacgcagagggctcctacggacgaccggaggagggagacgccgaaactgccgtgtaaacgaatgcttagcggagccgcgcccgggacgcgtcgtttcttgcgaaacggggtggatcgctcgcccgctcttagccctcgcgtacagtgcgtcgatcgttaaggtgtacgtgcgtgtacgagaccgcgtgcgagcggtctcgtcgtagtgcgtatgaacgtgtttattaaaaagtctttctcgcttcggtcccgtttcggtgtctggcgatggcgcgggcgggggagtccgtcgcgtaagtcggggaacgtactttgtcctctcctctcccccgaggcgggatgtgcgagggggggggcgacgggcgaccgggaatgcgtgcgattagtgttgtggagaacgtaccgcgccgaggcccgcggtgcgcgcgaagggttagttgggggaggggcacgcgcatcataagtcgctcgcggatcgtccaggtgtttgtgcgggggatacagtttcgcgacggggaggagccgttagctcaccggccccgcgggagacgcagatgcgatataaacagccccgcggtccacctccttgttcgcgacctgctacttagcctcgcttcgttcccacgtataagcaccactgacttacgcggcgaccgtggaagtcgcgagttccgaccagtgtcgcgtatatgtgttaacggcccccgtcggaaccgaattccacattcgagatgaagtgctacggaatcaggaatcccgtcccggccgcgcgcacacccacacacacccccacacacacccccacacacccccacacacaccgcggctacagagcggctgtcgtagtacgtataggcgcgagcgcgaacacttgcacggactctcgtcgtagcacgttcaaatcggtttattaaagccctcatgctcagactccgtgtcgatggcgggggggggggggtggtgagtgacacgaacttactttcctgcgacgctcccgagaggaggtgtgcaccgggccgttttctccgagactgaaaagagaaagaaaagctccgccgttcgcccggccgagcgcccggacgcaccggtgtccgtacggccttcggacgcttagagagcgcgggcgtttcgcgccgctgcggcgtttaggcgcgcagcggcgcgtttgcaaaaaaaaagaatgtacggagagacccgcccgccagcctctccggcccggagcggaaacgccgcgttatctctacgcccccgacccgcacatccgaatgcgcggtcggatcgcgaggttaactccctgcccgcgcccgcgctccgcgctccccctgcgttgtttaccggttcgcgatcgcgatcgcggaagtcgcagggccgacttccttgtttacattgaatacgtcgacggaagcgcaactgcgtatgtccgccgcgcagacgcagaagcgccggggccgaatccgggaagaagagtaatacggggcttctccagcgcgtaagtaccggcgttccgggcggtcggcgagtcggcggagaaaaggtggatcgcgagcgcgatccgaatccgcgggccgaggggaaattcttcctatcccctgtgcgttgagcgccccgtgccgtgccgcctttttccgtttccggtcggactcggagccttcccgccgcacggttcggactcccccccccccccgcaacggttttattttcccgcgttcgaccccggcgtgatgtccgcttttctgttaaaccgtgcgttcgtcttatagggaagccatcttaattctgacatgcgcgaatgcgtctttcccccttccaaggcctaaccccccccgcgctttctcgtttccgccgtgggccatttatcttcccccccgcgtaaacaattatccctcccccgcgcgtcctacttttcttctgagacctatcgcctttggcgattctagtcagattgccttttatagtcaagtttcgagcagatcctaagcaagcatgccctgtaccccaccccccttctaaataaatttccgatccctggaggtttccggagtatttgtcccaggagcggggtcctatgcagtaatcgtaggtctttcatgtatgggggggggggagggggggggagatgcgaacgcccacactggtgttggttcgtccgccacggaagctggaaccccatcggacgtctcggcgccctgtttgcaaaatgtcaggtacttgtagtgcattccacgtaggaaaatggtcgtgaggggagggggggctgagtttttctgttatgggtatcctgaggggtctacgtgaaagtgactggccttccgttttcccacagaaacgttgtgtggtacggtgcaccctgagagatgatctatattctcaggaagttccgtgcccgaaacgctctgaacgataagcttctagattgcatcggggattcctctgagaagagcgggtggggaaatacatagccgttaaagtctcgcggtccgatatccccgtttggccggtggatgagtcgcgatggccggacggggccggaaatgcgatccttcttttgcgggctatttgcgatggaagggaaaggcaaaccggaaaacttaaggccgtttggtgtgtttttcccttccatcgcaggtcgtgccgcagtacttttgaatcggagggagacgtcgggcgagtgggaatgggcatcgcggggtcatcctttattctgggacgaccgcgaatctacgtgtcgtctcagtctggacggcccatggaaaaaaaaaagagtcgagaggcgtggggggggggggaggcctgaacggccggcgcgataagggatacgtggtcaatcttggcgattaagcctagatattgcgcggggagtggggcggcggtccaatgcctagaagggcattattcgaaatttggagtcgggctgcgtagcgacgggtggcgcgcattaatacccctatcttttttttttttgcttcgtttcttgtggccggcttgggaaatgtcagcggaaaacatgcacccgctgtgtgaatgtaaaccgcgtaagtaaacccgtgttagactagatttcgcaagttgcgaaggggggcgattggggaggaggaagtctgaacggaggggggagaagggaggggggagggggaaggctgaacggaggggggagaagggaggggggagggggaaggctgaacggaggtgggagaagggggaagaagggagggagtggggaggggggggggagaagaggggaagggggaaggggggaagggagggggggaagggagggggggaagggagggggggaagggagggggggaagggagggggggaagggagggggaagggaggaagaggggagggggggggaagggaggaagaagggaggggggaagaagggaggggggaagaagggaggggggaagaagggaggggggaagaagggaggggggaagaagggaggggggaagaagggaggggggaagaagggaggggggaagaagggaggggggagaagggagggggggagaagggaggggggaagaagggaggggggagaaggggccctggcgagatcggctctgaattcttcgttgtagatagcagacgaccgtaaacctgaagtacctgtgacttggacggtgatgagatgtttggcctagttacagggactggcctttgttagacacgatggcctttggaaacgcatccagtctgttttggcatctgagtggcgcgtagccgttgtcagatgccagagagactgaaatgtttctcgaggactctaaccgtaatctgaataggcccggaccttaatcccaataggccgtgccgggatatcagaggagagccgctcggaccgctgcgattccatccttcgactagcgacttgttatggcgggtaatagccggacgacggagtctcggcggttcgaccttagcgggccccggataggtttctcggttggggacaaaggggaggtagaggcgtcggatgcggggcgatgagcgggtatttaggccacgagatcaggtgttgtgaggaaggggtaacgacgccgtattgcggtcggaccgcacgacggcgcgtcgtccagtccttcccgggtcccctagaggtgtcacgttctaggacaaccgggacggacagggcgacgcgcgcgaaatgcctcgtatcgcctgatatgctcggaacgagtcggggaagggcgcgaaagcgagagttactactcggaactcgggactgttcgtatgttttctctcaggctggcattgcacgtgtcattgccgttgtgcaatgcctgcggagagaaagacgaattgattccccgtgccgctccccgtcgtgtgggacaaggttgggagggctctgggcgaagaaccggctgagcatcggcgcgcgcgccgtgtcccccctcggcggtgtgcacgggagtatcgggcgccgtcctcatgcccccctccgagggtagcacgcggtggtcgctgcggtcttttcaaaacaggttctgcgaagcagagatgcgtcggcgcgcgagcgaagcgaaccgagctctgctccgtccttagcgtggtgcctgagattttaacacgtatcgtctcaagtactgcgcgcaaggaccgaggcggcgttccaaacgtcggacgggacggcgcggcgtcgtcgcgcgccgcggaaatcgttacacgctccgcttcctccttcgcggggtgcttgagatcaccgaatgacgggatcgagcaccacgccgatggacggagatggcgcgcggtacgttcactgaatcgcaacgaggccgggccgcgctgcagggatggccgcgggtacgcgcgccgagtatgggggggcgcgtgctctcctacggccgactcttgggagcgtgcatcgttcgggggtcggctgttgggtaagacgtggtctctttcaggtcggtgctgttattttcggcggggcgcgggacttcgtcctgggccgtcttacacgcacgtcactctggtcgtatcggtagtcctagtggcttgcttgtaggctgtccgtcggaggaagacagcaccgccgcccagctgcctgtgcgagcgcaggactcgtgtccacgtcctgcgtgactgttcgcccgccgttcggatggtccgtggtacggtgtcctgtgttgtgtgagaggtctccgtacaccggaccatcgaaggggggtgggggggatatgcgaccgcagagcgacttttaggctgccgctgtgcagtgttcggttgggtggggagggaggaatgtctgtaaatcttacggcgatatgctggatcgtgagaggtgagtacgtgtctgtgcgggtaggtgggagcataaccacaaaaagactagaattctgcccgcggggaaatggcggtgtgtgtaatgcttctgttccaaacgaaggtgcggaataggagcgaaatggaccgaccttcccccgcgacgacgtaagtggcttgttacgacctgggaggcctagctgtgttctcgctcgttgccagtggataggctcgcccttttttgtaacagatggcgatggaacagaggttcctatgtgggggggggggggcgggaaggataacgtctatcgatcccgaagtcttcgttgcggatatgagacgatcagtactctcaccgatctgcatatcggacgcggaggggcgagagagggcccgtggttaggcgtctgtactccgaactgcttccattttttcccttacggtgcctgacgtcgtattttaacggttagatgccgtcagggaaagatgggagtttgtttgctcgagccctgccggcggactgcaggcgaagaagtagccgggcgcgaagcggctgggaatcgggtcgcgtggcgtgtcctccttcggacgagtgcttgccggggagtaaccgtcatgcactactccgggggtaggacgcgacgtgcgacgcgctctccggatcggtgccgtgctgcctgagatcgagagcatcggacggagcccagcgccgtcctttgtgctgtgtgtgagaggtcgtcatcccttctcgggcaccgcaccgaaggatggagtgggccctcgaaacgtcatccggaacgccgcgggacgaagccgccccggtaaagtccagacgcgcgcagttccctccttcgtccggtgttcgaggcgtgagacttttgtattgccgcgtcgagcaccgtgctggaggaaggagatggcgctctactccgggacgaaggcgctgcggagcgcatcgcgtggtgttagaggtggatcctgtcatcaagcaccacgtcgatggacggagactgggcgcgaagcgttctgcgggatcgcgtggaacgagggcgcaccctcggtcgcgattttctcgacgcctaccctcggcgttgttcgtcggccgagggtaggcgcagaggaaatcgcggtcgctgtggactccggtgtctggtatcatgtccggctcgagtcgtacgtcctgaaatgttgcttctgattccgacgggtcttcttcacgtacctctctatggctgcatctttatggccatagtgaggtacgtgtaggctacctgccggagaaaggcggtcccgacgaatacgcgtcccgtgtagcggtcgcccgctctgcgatgggctggttccggcatcaatattgcagggtctatttttgtggtgggcgtgaccgcgcatcgcatcgaaataaatctttaaaccggccgagttcattgttgggctatgctcggttttcggggggggggtgtggaaggagggtactaggttagggttagggtcgggcccttagggtcatggtcagggttaggcctttaaggtcatgcttaggtctttaggggcagggtcgggcctttagggtgatggttgggcccttaggggcaggggctcggggtaagggttagtgccagggtcgggtgtcagggtcatggacagggatatgccgttaaggttagggttggggtccaaagttaggcgtttaggggtcgggtcgggttcggggttaggcctttaggggttgtgtctggtttagggttaggcctttaggggcagtctcggggtcgtggttaggcgtttaggggtcgggtcgagttcggggttagacctttaggggtagtgtcgggtttagggttaggcctttaggggtagtgtcgttgtcggggttaggcctgtaggggtagtgtcgttgtcggggttaggcctttaggggtagtgtcggggtcggggttaggcctttaggggcaagctcaggtgcagggtcggggttaggcctttaggggcagggttagggtcagggtcggggttaggcttctggatcgggtctttagggtcggggttaggcttctggatcgggtctttagggtcggggtgattatgatcagagactaagagcgcgaaggcctatcagtgttaggttctctgggtcagggttaaggcctcggggttagggtctcaagggcggcgtttggcttaggggcccggggttaggacctgtcaaggtcagggttatggcctatcagagttcgtggtcacaggtgtaagggttattagggcctattaatgtcaggccctattcgggttaggctcccaccgagtactaaggttagggtcttgtaagggttggggcccgtaagggtaggggctggggtctgttacgggcagggccccccccacacggttcgacctgccacgcttaggttcccatcccccctcccccccccgagtagggttagggcctggcaggggtagggtaggcgcgaaggttgggcccgttagggctaggagcgaccctcctccccccccccattattgttagtctgttaaggaggcgttccccctccccgtcagggttagggcctgttaggggtagggtaacagggttaggttaggggttaaggtctctcggaattagggcggggcgtgtaatggttatagggtcagggcgtgccgcggattgagggtcggggccggcgagggtgtcgttccggtgtttacggaaacggcggatgtgcgcgcatgcgctcgcgcgcgagccagacggacggacggacggacgcgtctcgtagcagcattccatgggcgtttttattcgtactggccgacggcttcagcccgggtcggggctaggagcgcccgcgtgcgcgatgaagccgccgtctcccggcggcgacgcaaaggctgcggtccgcggttcccaagcgtcctgcgtccccgccattgctgcaccgctgccggaaaaagaaaaacatcctgtacgcacttcccgagcgccgggacagaggcggtctccgccagccccccgcgaaattccaaaaagccggtgtggcggactcggccatggaatctacggggggggggttgagggggggatgcggcgctgtagtcgccggatgcagtcaggacacggaaattaagcgcgtccggacgtgccggacaatcgcgtacgcggaagtgcttgcacgggaagtaaacagtggaccgcggcttaccttcccagcaggagtacggtgttcgcggagaaaactgtaaggcgggagcccatcgtcgtgcgctcccggtcctctcggaatcggctgcgagtctcaaaaaaacaggaaaggggatcggcctcacaaaaccacttcctcattcgtgactgcgcgtagcctccgttcttgaaagcggttggcgttcgcacagacctgagtcgacaccgcctacctgttgtttactttcaatgtagtgcgttgcacagagacgctcggggccgggtacaagttgcccgggtccgcgggtctgaagcacgcactcttccgttgaaggacggggtgggaaagcggattattggaccccgcgatagggtctgttagggtcgggggttcggcctgtcatcacggtcggggttagggcctgtcttattcgttttagtgcctgttagggccacattaagggcttgggccagggccgtttacggtggcggttagggcctctcggggtcggcgtcaggactgttagggtcactgttatggcctttcagggttagggtaatagtccatagtcggggtcaggacatattaagggtagcggctttggcggttacggcatgtagggctaggaccttttaatgtaacgggcagcgttggtgtcatgtatcacggtcggggtgactgttaggcctcgccgggcctcatttcacggtcggggctatggcagggtcagagtctgtggtggtgtgcttcggtcacccactgtgtccgcgcaatgctgcgcgttcattctgcctgtagccgacagttcgcggggtgcggcagcccgcgggctgagtgcacctgtggcggcgggaggctgcggcccagccgcgttaattgttgtgctatgttccttttttggggggggggtgaaatgcagggggggatattaagttggttagggttagggttagggttagggttagggttagggttagggttagggttagggttagggttagggttagggttagggttagggttaggccgttagggttagggttaggcctttagggttagggttaggcctttagggttagggttagggtgaattttttttattcagttcgccgccgcgagagttttggtatgacgtttggtggtggccagggtccgccgcgcgcatgctccctacggtccgccgcgcgcatgctccctacggtccgccgcgcgcatgctcgctagggtccgccgcgcgcatgctcgcaaatgtcgactgcgcgcatgcgcgcacgggtccgctacgcatttccgggcggcctagcgagcgcccgcgcggccggcgggcatgtccggcggggatgcagcgtgcggctcggcctactggccgcgcggagccgccggcggtcggcggtctaacgcttggagtcgcgccccccccccccccccgatcagacgcaaggctttttcaggcgcccgtctcggtcacttaggacagccgcggttcgtctcgaaaaaggtctgcggcgtgggtggtgggggaaagggggaggggcagaacagtccagagaccgtcacgggcgaacgattggggtccgcggggggcgcgaggtggactcggtagccgccgcggtccgatccggaaaccgtgtcccccctgcgctttcttcgggcccgctcgccgacgcgaatggggtgggggaggggggtgcgcgggcgaacaattagggaccgcggagtgcgacagcgggcctcggtagccgccgcggtccgatccggaaaccctgtcccgctgccgctttcctcgggcccgctcgccgactcgatcagaaacccgtctcccccgccatttttatgtctcccgtatgcgcgctcgttcccgccactttctggtgccgctgcggaagaggatagccgggcgggcgagcgggcgagcgcgccgcggaccgaaccgctccgcgggctgcgcaggggaccgcagagattgctcccgcgcgagggatcgatccgcggggtagagggctctccgcgaacagcgtaagaacagaggtgtccccgcgcgccgctgcctccggacgcaccccccgcccccccccccccggccacccagggcgaccgaaaccccctgccgccgccggcaagagtcggtcagagagcgcgaatgatgtctgtcgcatctggtcccttcattcattcattcattcattcattcattcattcattcatttatttatttatttattcgccagcgctacatctcaatcccagctaccgttaaccctaccaccacccccccccccccccccgaccttgagcggttctatccgttcgagatgaccttcacggagcggagctcgttgcaggatccggaggagcggtttccgcagccctagggatcgcgattcttcggtacagccgcgcaggccttcggaaaggacgcggcgatctgagtccagggggccacggctccgcgcccgcggtttcggttcccgggcagaccgccgtcggggacccccgggagctttcggagaaggtagggcggagttctgaggcttgagggacaatgagcggcgggtcggttcggttcacgtcgccgtcgggatccggtgcggccccgtccgactttgccgtgggaggctccattgtccgtcccctcccccctttggcggagcgcagggcgaaaggaccccgctttcgccgccgctcctcctcgtacaggccacgggtcttctaggcgctgtcgccgcgcggtcttccttttacgaaactttctctaccgcgtttgcgggagaacactacggcgaacgcgcccgcgggctcgccggcgcttctgcgctactgaatggccgggcgaaggtgcgcgcggggcattcgttctgggaacaggtatagaggcgtggccacggccgaccaatggaccaggcggtgacgcatccgcacggcagaccgcggcccgtacgactaacagcgcggaacgcaaccgagccgcggggttccgctggccccctaatttatttgtccgtctccccgctcgcggatgatatgtcgtacccgcggggctgcttgtccagatagcccttaaaagtccgccgagtgactccccccgcccccccccccccgaccctgacttagccttcactcgccgaagacttcagagtcgctgagggccaagggcgaaggaggaccgggcagcgtcggaggatgaattatcctctgtcgcgcgccctgttcctcctggacggtggtctccggcggaccgccgtccccttccagccacactacagacgagctacgtaggtgagcgagcatctcgcgggccaataaactgcacgtcgcttcgggaacgtgaacgacgactggctgggcgtgcggatcgggggggaggactacggagcggcaaacgtcgcagacggtcctatttaagaaatcgggggaaactatggcgttctttttgggctccaagacgtacacgggacgcagcggggcgtacagtccccacttgagagcggctcggtgggagtgcgactctccagctaaaaagtcggggccgggcggcctctggcgcccggccacaagggccgaggaggctgcgaggtaggagagagcggtcattgggaccgtcgcgacgcggtccagtcgcgtcgcgaccttgtatcggacgttgcttccgcagcacagactgatgtcgccggccgcggggttttcgcggcgaaagtgcgtttccagctcacgtaggaccacggggcccagcacgtcccgcgaggttatgaccgtcgtagctagatcggggtggccaggccatcggacggagcattggctgcggggcgagacggtgcacctgacgtagcggacggcttcttccacgaggcgcgggccgttctccgggcgatcttgatcctctagcgtgtccaggaccacgagccttttttctcgtttcaaacagaggcgttgcaggtgttccaggacgcccgcaaaaccgaggtcctgaggggacaggaacatgacgccggccgcggtcagcgccgaaacgtccggcgccgctctccaccggcccgcccaggcggcgctctccggtaggcagaggcggttggcgagtgcggcgagcaggaaagagagtcctccccggttcgggtcgaaccggggtcccccggggggcgagccgggcgccggtacgcaaaacaggtgctcgcctgggttggccgtgtacaggatgacgagagcgacatcttcaggcgaagcctgctgatgccgcatccaagcggtgcgcgctctgagagagacgacggccgtgcggcacaacactccctcggacgcagcagtgtctgggcttctgctgacgtgcgagggagtgctcgccacgcgagcgatctccgccatggcctccggagaacgcgccaacggctgacgccacagagtcggtatttgggcgaagctggtcagctcgtcgactccttcgcctggacaataggcgtcgaggtgcggggggccggcatagccagcaatcggagttccaatggggggcttcctaaaggcggcgccacgatgccgtcgatcgcctaacgacagggaaccgtccataatgcgcgcggggtcgcgccacggaaagcaacgtgggcgcttgggcgggaaaggcccggcgtcgcggcacgcttcagggggggtggggggccttgtgcagctggcgacaggcggaggtccggcgcctgtccgggaccttcccaaacgcggacgcgggttctcgacggcgttgtccgcgccgtcgagaaccgccgcgggagctgattttctcttccttgactcggctgacgtttgggcgcaaagggcccgcacgggctcgggagaacttgcggggccggggtcgtaacaaggctccgcggagcgcgaccggccctcggacgttccggaagaggccgcgtcggcgtccgcgagaaggcgcgccacgcgttgcagccgtcgggccttctcgcgggatcgtaccggttcgcccctcgacccacattcgcgcaggagcacggaagtaatgtccctcgacccagggcatcgccaaggccgagcggggtctttgctaagcaacgggccgatcgcttccgttatcagggccaccgcattagccgcgagagttcgctcctggcgcccccgaggagccgaaccgttcgcgtaggccgcgtacacggcgctcctgagatcaagcaggtctcggagccacgacccgagcagagcccggcatttttcccactgttcgtggccggcgggtcgagggaagggcccgtcctcgcaagacgacagcatttccgcgaccgcgcccggaccgtcgggtccgcgcagaagcgccgccacgaccccctcgcactccagcgcgcaagcgtccaccagctcgttcagcggccgggtagacgcgaaaccgtccccggcagggatgtccggacgcgcgggcgcgaccaatcggtattcggggacgtccagcaggccctcctctagcgcggaattgaaggccgcgacgccccggcgcacgcggtcgtggatcgtggacacgtctattaccgggatgagcccggccgccgtactttgggcagtgacgggtgcccgatttgaaataggcgatgccgaggggcgtcgcatttcggcgctggctgcagacgccataggcgcgtaggctttcctgagggagcggaacatgaactctttctgatctttgcagtacctgcgagtcatagacacgctggcggcgatgtgcggtagcgcccaaagcagatttcgcttcttcatggcgctggctatgtggggtatgcatttgttgaccgtccccgtgacggccgcgcccggcgaactgtgcgagctctgaaacttcgtgacatagatgtgattgagcgctgcgtcggtgggcgagagcttgccgtggtgtgcccagttcagggggttcgccttcacgtctttgttaagcatggcgcttacgagcgcctcgtactgtttggcgcagttccccatttcctccacgtacaccgggaggggaccgggagtagagaggaatctaacggcggcctgctctacttcagggatgccccggagcgcctgtcggtgtccgccgagaggcccgaaccagcaccggccggccggcggggagggaatttgccaccacacctcttggtcgaggtcatccggcggtggcggcgcagcagtttccgaggacggtgatggcgcccgccggccgcggccgcgccgtcctccgcggccgcggccgcggcctctggcagcgcattgaggcgctcctgcctcgcgggtcggcgacctggatgaggtgcgcgaagaaggggcggcagacgactgttccgatgaagagggcgcggacgacgaagaggacgaggaagaggaagcggacgaggaggaggaagatctggagcgacacccgagcgaagggtacgaggccgggggaggccggggtaggggatgggaagcgcgggtcgccggcgtgccaacctcctgttgtaatgcctgttttagaacagcaggtggagctgttgtgtgcgaaccatcggagcccgatcccggctggactctgcggtaacgttcctgcgtaccggtggggctgctaacgaggcccggcctcggagacggcccgttccagtctggaacgggaagggggggaaacatgggcgctccgtcgtccctcgcgccggacggctgacggaggtgtctgaatcggcgtagcgccgcggcggtgacggcggcgcgccaatcaagtatggctttgtacagaggtctgacccgtttttcgatggccggaccgcaggcggggaaccccagttcgaccatagcgacggcgagctgctgcaccatgaatccgtaggcgcgtgcgggacgagagccgtggggcgtcccgccgggttccggatttccgttccgcagcgccaacttcgattccctgacggccgcggaaagcgcgggagggagcgcggtggcgggcggggggggcatttcgaaaggcacctcgaagccgggccgcacgtcggggccgacgatgtagtcgtctggggccagcagtaacccccgacgcactttgaaaaaaagacacctgtaatgtagcatcttgaaatcgttccaggtgagcccggtccaggggttcgggctgccttcccggccttccacccaccgaatctcctcgagcagaggacagaagttggaggcatagaagccgccgcggcgccggctgcagtcgagaccgcggggggattcagagggcggcgttccgttccagtcctcgtccaagggagtacccgcgcccggcggcggcgcgcacgccggaaagcacggcagaccacgagccgcttgtaattgataggaaaagtcgcgtgtcagaacgtgggccatgtactggacgcgcctgacgcagcggagtcggtccagccagcggtatgaaaggcggggaaccttcgacacgaaatcgggggtgacttgaaggccgaggaagcgaaggagcgccgacaaaatgtaagcgtacgtcggggtgcgcggagccggtctcgggagccgtgttaccgcttcccagatgcgcgttggcagcactatcggggcggggagggggagcgggcactcgttctgcgggccccatccgcaaccctgcgattctaacacgctttccccgtcctcggacggcgacatatcgtccagggtcgagagaacgaggcgcgcgcatcgagaaaacaaccacatcttgcaggccgcccagtcattccccagctcgttcggagggcacgggaagaccggctcctggggcagcgggcgacccttcgcgcaacgccattcgaacggccggtagtcgctgtcgagtaaaggggcctctctcggcagttcgatagaccccggtgaggtccgcagagggctgccgcgcggagtaggtaagatttctctgagtaccgcttccctcgccagccgatcccagtaggaagggcaccggcgagcgtccgacaacgcgaggagaaaaaccttagggttgtctccggaggacggctccgtcgcgccgtcgcgagcccccgcgcgccacaacatagcgtggctccccggctggcgggccaccaactcgagctcttctcgagggggggatgggatcctggcggatgcggataggcggcagacgtactggaagcccgcgcccctggtacgggggcccccgccctcggaaacgctcgatttacggcgggctgggactcggtcgctccggaggggagcgggtgcgaggcggggggctgaaggggacaacggaggggaaggacgctgacaagaagcagagagggctggggggtccggggaaagaggcctgtcgtggagaggggttggcggaggtggggtagacgccggaggcgagtcaagcggtagagacgcagacggggaggatgtctgcgtagagggaggggaggtagacggcagaggcgtggggggaggggaaccgtgcggagggggggtatgcggaggtggcgtaggaggaggggggctaaggggaggtggcgtaggaggaggggggctaagggggggtggcgtaggaggaggggggctaaggggaggtggtgtagggggagtgggtgaatggtgttgagcgaacggtcccggcgtcagcggagaaaatgtccatgggaagttcacgataggttcgggggggggtggggggggcacgcccgagggaggggggagagtttcgacacagacggcgagcggcgtgcaggcgccggtgggcttacagggcgcgtcagatacgcagcggacggggtcgtttgatttgcggggatccatagggctcggttcgccccgttccgaacccgcggggactagatcgccgactgtcttttgccaagaacaggaccgcggggccgccgcggccgtttcgtttccacagacgtccacgatgtccgcggtggaactgacgacctcgccaggagacccctgatgcgcgccgtcggggggttcggcggaacggagacccgtatccgaaccctccgaaacggcaccctcaatgccgaaaggggctcgtgcgccggcaaggctgcccgcgacgggagccgcgcgggcaggggatttagaccgtggcgggacgggctgccgaccgggcgtcgggggcacggccacgctcggtgtattcaagcacacgtcctggtacggatctcccggggtggcgggtggctgcggagaaaatccgccgttgtcggctaacatctctaacaggctgtagaaatcgggcgggttctccatgtccgagcaatgggggaaacgcgcgccggtccaaccgtggcgacgccggcagcactggcgatccgctccttacaggggcgtaaatgcaggggttaatcgggcggatggggaccagcgcagggagcgcggaaggagtcctgctctgaaaaaaatgagggggaaccgtgagaaagcgttccccgcagttcgcatcgcttcttgccccccgcccaacaccaccaccaccccgcccctacacacaccacagccacggctccggcagtgccggcctggctactcctttaatcattaactcccatcaacgcgatttgatccccgggctgctctccgaatcagccgagccccataggtaaacattccgccgcccacaacgtttcttgtcaaacaaacgcttatcggccggattgcgaaacgagcaggttttgccattagatatgctgcggtcagcgctgctaggctccccgggggcaaacattctcctagcgacgccgaggtaaggagacattaaccctcgacacgctcctgcgagcgactgtgcggttcgtgcggtttgtttctctcgctcccgacgttcctaccgccctcgggagagtgctcgcccgggggctagaacccgaagcggaccggcccttgagcatcgagacgcttaggctcgggcgaaccgcccggctctaaaaagtcaagcgcgcgcgtgtatttcttttttttgggggggggggggggggtggtggtggtggttggagacagaagaggagagaaacggagggggtggtggtggttggagacagaagaggagagaaacggagggggtggtggtggttggagacagaagaggagagaaacggagggggcggtggtggttggagacagaagaggagagaaatggagggggtggtggtgggagagaaataccgacggccggacagagcgaattattaagcacccaacgctcacgccaacacgtcccacctctttccccgacccgcgccgccccccccccccccgatattcgcgtcgggggtcagggacaaagagaggcgacggggcaataggcgctgcgtgggggagggggggccggccctacttgcccctaacgcaccggcgtccacgcgatcgcgcgacccgacagcacctaccaggagcgcggtgccggcggcagccccttctcgattcggctcggagctagccgggagagacggccgcggtcacgtctccctttccgaacgcctagcgatatagttacagaccgaagcgagccgtgtcacaccaagtcacttagccgcaattctgttccccttcccccacacacataacaggagacatagcgcatgggaggggctttccttatctctcgagcagaggtcgccgacacgtcaacgaagggcggtacgtgtgtggtaagtagcagagatcggagttggtcccgatttactaacatctaataccgatcgttcatagccgcctggaatttgcgggcataacccgcggataacggtactggtcagggaagcaacgcagcgcagacacgacccgatataaaagactgcaaacgaggttttgtaggggtaatgagatgatgtggaaaagaaatgggtcagggggcgctgtttgttgtgacacatttgcgcctagtgtgggaccggggcgtgcggcgagcacccagcgcggaacgactcgcaagctgacggtgcagggctaactcgcattagaggaagtgtttgctgatttcttcgtagacgctctgcgccgagagcgtctcctcgtttaacctttatgaagaaggaagtcgctcccatctggtgcggaacgatggggtacttctctccgtaatggggaaccgaaaactgaaccaaatacagaaattagaagaggaacatcggcttttcccgttatgtaaaaggaccatggggtcgcgtccgggaggagggggagagtttggggaactcggggccctaagagcgctacaccagactcttcataataccatatgtcaaggcagttgcggtaaatatagcgacgaccgcaaccgaacgggtatttcttctacaggttagaaccatcccatgacccatgcgaaaagtgttacggcacagagaaggccagagggaaactccgcgtccggcaaagcgcacggtaagacactcgcgaggttgtgcaacagcgcatcgccccgggtagaaccgacaggtttatcttcagatggctatcgcggacaactcgtcgtcggggctgggggaggggggggtatgtgtcagccacttccatcctcgtcgctgtcgtcgctcgcaaatgtgggctatcaacgcttctcgattaaaaaaagacaaactagaggggcatccgcaataaacgacaatgtttcatcacaaaacaaatggcgtggtctattctttttcgtttgcctctgatcctgggcggtccgtactgcggggtgatagataaaagaagacaacagcagggaatcgaggtggcgagctcacaaattgcgaagctcagcctatgccggcgatgatggccgatgagggaatgtaggaagagagggcgtatccccgattgacgatggtgcgaccaccaaccgagtccgtgtactcctatcttccattctcacgacaccggacatgagaaacgatgcgcggagcaagtcgggggggggggggggaatgaatccacggcacgcgcagcgcttcctttacattgcaccacgtgaccatattcccataatgacggcaggcgttatctatataatgccaggcagaagtcttacttccgctcgcgatcactattgtcgtcacacggggagtctgactaggcggtatggacggcgtacgagacagagtattacctgatacgtcaacggacaacgagatctaccttgggtcggggtatccggtgcaattacatgatgaatatgggcaaatttctctaggctcgccggtcgaaagcagcaatagcacaggaaatttttgtgctccgccatggatgccggatatccctcgtttaagtaatgatacatgtaagatatttcggtgtctgactagctgtcgtctcaattgcgcaccgttccacgatgctctcagaagagccttgctcgatatgcacatgttaggtcgaatgggattccgtctacgacagcacgaatgggaacgtatcatgcagttgactccagatgagagcattaacctgcggagaactctcctggaagccgacgagcggagcagtcattgtatgccgaacgtgtacgcatctgacattagtaattccctcgaagctggtacaatgcaagttacctccagctccaatatccggggtatcagcaacaagtccgtaaatcactgattacaaaactcactgatgtagacgaacaataaatgtcctattgccagtaatcactttgcctgttatttattgaatgagtatgtcgcgttaattaagtaacgcagtgtgggcgtgacttgtaccatatagatttctattgactacaacgttatccgacctgacatttgggagctgggtgtctatagagacagaaggtgcaccaccgcgcaagataatattgtgatatgtccagtgaggtatgtgaagtaccatcaccgcaaaagcaaatgggcctgtggtcggtgtgccgcaaacttcgcagaacatctcatctgtggccggatcctgcgaatgagaaagtatacggtatactttctgctggtggagtacatatatcatccctgccaaagtctgtacgcggtttggcccgaactgtattgaccgctgccatggtctctttcgcggcaatgaaagctggtatgccgccatccattcacctgtggcgtgagataatggatttaactgacgcaacaatccgccgcgaacaacggtccacatcaaatttctacgtagccggttcgttgaggaaaatagtaagtgttgcattgcgaaattataagcatgcacctgaaacgcatggagaaatggatagccgtctgactgctattatgtattggtgttgtcttgggcatcctggctgctgtattgtttcccatttatatgaggaaaacagtgatctgattaagttgttgggaatggcaacaggctgtggagaaagcccgcttactgaagtagagtcttattggaagcctttatgccgggctgtagcagcgaaggggaatgcattaatttacgacgacgtcgaagtggcacattacctgatcaacgtgcgacaatcgtctgaatcttcgcctccagacgatggggaagacattgagtaaatttgcgcgaatgacagggctcggaaacaatgtatagagttttgcaaataaacactttattgacttaccagaagttattgcatcttattgtaatctgcgtcaatattctctaacttcagttaaaacgtagcaatcgcagaggggcaaactagagaaaaatggacccgcgacctaaatctcgtctaaaacgctccagtgctttacagttcgataatctggacctggggacgcgtataggatcgttcctccacatgcgctgctgtcggtatctcgaatccccggtattcagttgaatcgttggcggagtgtcctcctggactctgcaatgttccctagccgtcttcactatctcgtgcaaggctctataatacagttcctctgcagacccgtcgttgctcttcccttctgcgtcgttagttatttctgtaggctccagacgatttgcctgcatttgtgcgcaacataatctgattgcattccctatctcgtcttccggtaatcccataggtgttcggtattcgcagataggtagagaaagcaccactgcaaatcgtgcaatttccattgccccaaccaatattttttttaagaacggcatcgccgttaatgtacctcgggcattgtgacgatcgaaacccttatggatgcctaaagagagcattgcggtccagttctccaggtgaaaagagaatagcgcgggtagaaacgggccgattagttttatcttcgccgcgtccctaatatcccaagttctgcagtataacttccatcgtccgttttcgacaaggtccggcgcgacatagtttgaaatgtcatctatcagaaacatctcgcccatcgtagaaaaaaacctgtacgcagaccataaaaccattcggtaccacatatccttgtgtatatcaaacgatatgttggttatgtcgttggcggatgttgtatgaaatagagctaagcgttctctggattccacgcactgaacgattccgttagtcaattcatctgctaacataggccaaaagtttattcgtgttacttttctcggcggtttggcaaaacgcccccttggcacatccatgtcattaaatacagcggcataactcctactcatgtgttccatagcccaggtttctgttcggtctgctactacgatcagatcagtggcgcgatcagatgcgtgggatgaatgaagtgtatccgaaagcagttttgagatatacgctaaactgtacgacgattgtggcactaaacgaagctttgcgcgacccccatcccacgcggagtctgtgcaaggttaatgaccctcgcagttcattcggaagttataactgccgccttcgcacatttctttttgtcctgttttgtattgccataacagataggaattgaaacctgatcctcctgttttttgcagcatggccagcaacagaatactttgtcggatcgactacttgcgcgagatggttccgttcttggaggtttcggcgggtcgggtggagaacctattattttatacacacacgtcataccgttgtcgcgaaaatgttctttgtcttctgccgtctcgaacgtcggttcccacgtagacgttaggagcgttggaatggtatcaggaagagcccacggcatgccggaccaagtacccgctactttgaccgcgagcagtctcttcggtaatgggatgtattccagagcagcgcggcagagatcagcggcccccactatccacagactgtatgaagtgttttctgaaacatcggactccaacatcaaatatccagacataacatcttgccattcggaagcacatccgccgacatcttcaaatagcctaactataaacgagtctctagttcctgctaacccagtacctcgaatgccagtcccatccggtgggttcgtcctgataatcggtctctgacgccgaggaagaactaaaaggggtctggaaaagcggaacagatctgcagaccgaacgactacagacacgcccacatcatcatgtatctgttccatgcattgctttatgagaaaaatccataaggccgaggcggcatctctagatctcccggggagtctctcgcactcatctaggagagtgacgacagttatcatagacacgcccatttgtgcaccaaacgaaaagttcctgtactggtggagcgtcggcgcgggaatcggtccgtgctctgaaaccagtgtctagacagaagaccatccggtaaattctggtgtatgaactgacggtctccagacgaacgtcgaagacattaacgatggaaactaacgagctttcttcaaaagtgtctgattacaacgctaatagaccttacgaaactatacgcagcgataccagtgacacagatccgtcggtgtcgtgtgggactctctccgacaaagacggggacgacgaagaatctatagatttaagcaaggtcccgaatgcaacgaatgtcggcgcaggtgaagattgcacatcccccaacgacgggcgcacagagttatgccgtacgacttcggttaccggaccggcctcggtcgtgaggatgcaatacaatattatttcaccattaccgcccagctcggagggccgcgtattcgtctgtacccgttgggacgatgtcagcaataagaaggtgattgttaaagtcgtcaccggaggtagagacccagggagagaaatcgagatcgtaaagacactttcccattgcgcgattatacagctaattcatgcatatagttggaaatctacggtatgtatggtaatgcctaagtataaatgcgatctgtttacctatgtggatagaaaggaatcaatacctttgaaagacgttattgtcattgaacgacgtttgttggaagctctggtttatctgcacggcaaaggtgtaattcatcgcgatgtaaagacagaaaacatatttctggactaccccggaaacgctgttttgggagatttcggggcagcgtgcaaattagacatgcatgataatagtcccaagtgctatggttgggccggaactatggaaacaaattccccagagctcctcgcgctagatccttattgtgccaaaacagatatctggagtgccgggcttgtgttattcgagatgtctgccaaaaaaaggacactgtttggaaaacaagtaaaaacctccagttctcaactgagagcattgattagatgtttgcagatccacgctttagaatttccacaggatgaatccacgactctatgcaaacaattcaaacaatatgcaatcccactgcggcctcctttctccattccagaagttgtaagaagaaatatcccgtcaatggatgttgagtatacaattgcaaaaatgctcacatttgatcaagagtttagaccttcggctcaagacatcctggcgttccccctctttgtgaaagaagccccccaaaatctccaggccctatttgttccctgagtgctaacagcacatgcaatcgaatcccattagaagccgtgctatttaaattttaatgtcgcatagaaatatatggtatacggcgccacgcagagctctatacggcttccactttagaagccaatgttttgtcatcagtgagtaatacgacttgggttacaagagacaaacataatacgtcgaacttaacaaatgccggaatctgtacccgttttctcatcgccgctgctgcatattaacggcaggaagcccttaggtatagcctgagcgtttttacgtccactgcattgccatattcgctacatcacgtatttctacaagaagatgagagtgtctattcaacgggcaattttcctgatatacatatgtacagtctccatgtccagctcggaaaaaactcgtaatgaggacgcctctcgtattagttcttcggacacctttcgcctaaaagaattccccgtatctgcgataccatcgcctctactcgacgtagtcgataactcgtacccgacgaaacacgtcatatacactgacacttgcggtttcgctgttttgaatcccaccggcgatccgaaatacacaatcctcagcttacttttgatgggacgacatagatacgatgctactgttgcatggtacgtcctgggtaagacatgtgctagaccaatttatctacgcgtattttcagattgtcatacaaatgaacaatttgggatgtgcacttcaaaatctccgggatggtgggatattggttatgcaaaaactgcgtatattgaccgtgatgagttgacgttagtattagctgctcctgctccagagttgggtgggctatacacacgtttaatcataattaatggcgagccaatatctagtgacatacttctaacgattgaggggacgtgtagtttttcgctcaaaggcccaatcgacgaccggctctgtaaaccattcaacttttttgtaaatgggaccacgcttgacataggcatgtttcctgcacgaactccccgaccccatgaagaaaacgtaaaacagtggcttacgcgccaaagcggaaaactggatacggttattggtgaagcgtccatgcgtcatgcagcagatttgccacgtgcttttagagattcgtatttgaaatcgcctaaagataacctacctgacgaccctggaaggcctacagtttcaattagcagtatccatgccaatgatgcctatgtaggaagcacctctctgtatgaccaatcgctacgcgcaactgaagagccagtattgccatctgtagatgaggcccgtcctgcgctttatacaaatgcagagaggaaccccaggatgcaactaataatttctgccattgttgttgctagtactgtaatggtcgcactgattgggataagtgcatgtattgttaggaaatgctgtaaaaggaaaatcaaaagagggatacctcaacgcccgtccaggaaagtgtattcccgcctatgattacgtatggacttgggcgtgtcgacacagacacaaaacccagtttgcggccttcttgaaactatcgatgtaatgtctctgtcgaacgggcacatggcacattggagtgcggcgtccaaaaaacatatactatgtttcctatttcttgtcacggggagccattctctaatcttcaccgggacttcgttatccgcatcgacggatcaatcggccatcgttgccttctgtggactcgacaaaacggtgaatgtttacggtagacttttcttcttgggtgactcggttggtgttatttcttacgatggaacgacagaaattctgagatggaacgaaaaactaaagtgtttctcggtcatgtatgccgcgttgtatacggactgcccccttgcagggtctgctttatttagaggatgtagaagcgcggtggtgtatgctacccctcatgacagggtgaagccggtttccgaaaaaggattactgctgtgcatttcagatcccagaatttctgacaccggtacatattacatccgcgtgtccctcgccggcagaaatgtcagtgatattttcagaattgacgtcgttgtgacgagtagcagtattcatacatgcggccatgcggataaaggtatacaggaatgtattaggtatgccgaccgtgtgtcattcgagaactatctaattggacacgtgggacaattgctgcctgtcgactcagagctacacgccgtgtataatgtcactcccagatcggtcgttgggacaaatactgataccatgtcagcttttactaattcgacaacaaaatctgcttcgacgaatttaatcgctatgaagactactcatccaccaagtacgcggcgctgtaacttgaggcgtgcccttccaaaattaatatacatgtcttcattggcaggcctgtgccttctcgtactattaattggtagagcggttgtaaagtgcaaaacgcccaaacccaaaatctacaagggcgactccacctctgacggcatctcgcttatcaattctgcagtaaacgacgcatttgggtgtaatcctgcaaaagaggttgatccctcgaatatttctgaaggcgagaagctggaaaacatgcagaaaacgaccggaaatgtagaaaagtaaccgtgcgagttatgagctggaatggacgttacatgcgggaagaagtagggcgtaactaagtacatgttagaaggggaggggcgggttttgacttttaaaagcacaccgcgggaccacggcggaattatgcttgatatacccgggctacgtggcataatgtcttgtccgcgaatgccccttttcctaatggcggcgatgatgtgcagtgcaaccaccgtaaatcgtatactaattccccaggggaattcggcaacacttaagatctccagatatccgccggttgtagatgggactccatatacagagacgtggacatggatctctaatcgctgcaacgaaacggcgactggatacgtatgtttggacagcgttaattgttttcatgacttaatcgttaaaatggcctgttggcggtattccaaagaggtaatactgcgcactgccagattcgtggtagagaggggcgtgttaaaaacgatagagaccgctaagctgcgcaacgctccgcgtgtattgattgtggacaacgtggacactcaatggactgttttgaatgcgagcgagcaaaacgcgggcatttatattcgatattcccgaaatggaacgagaaccgctcacgtagatgccatagtccttgccgtttctggtcgaaagagaggcagggtgccaccgacagtttatcctgttggaccatttttgcacaaattccaaatctcccttaaaaattttaaaacgttcttatatcaggtgggggataccgttacaatatcgataactacacgcctggagacgacggttcgtgcgttcaagttggagtttcgggtaatgtttctcccctacagtccaaactgtaagtcgttcactatttacgagccgtgtattttccaccccaaagagccagagtgcatatctccgtcggagctatcggaatgtcggtttgcatcaaacgcgcaggtcctggaaattgccgccgcacgctcggtgaactgcagcgcgggccgcgcgtgccattacgatgccgaggtcgacgaatcgatgcagcaaaggttcgcattcctttattcggaaatcccctcgtttacaattggcaatgccgggccgggggacgcgggtctgtacgtcgtcgtcgctctgtgcgatgagcggccgacaacttggactcacgtctatctatcgaccttggacaagatcctagatgtgcacgagatcgctcacaagccgggatttgatgacagagtcttatcgagcaatgacgacgccgctcgcggtgtaagacccggagcggccatcgagaaagaatcaggtaggctccgtctaagcggagccctaattgcatcgatcgtgctggtggccgcggccgtcgtaactacggtaagcttttgcggagcttgcgtcttccggtggcgtcgcaggtgccaccggaagacgcaagctcccggcaactcttgcaagtacatgtcgttgccccaaaatcattgggaagagttttacgacgacgttagggttggcagcgcccctcagtatgagcagtttaaccaaaggttgcccgagagaacgagatcaggctacaccgcttggctctcgtctgatatagccgccgtaagaaagcgtctcgattgaaatcgccgagacgtgcgtgccgattgttgtttttattgtatcgcccgtacttaacggtcctttatccccgcgcgaaataaaactgtccgactcagtctactggtgctcgcgtttacctccactgcgtaccgcgcgccaattttcgtgtaggtgtgcgtatggtggagtggtttgggggaccctgtctctaagccggcacactccacgctatttccccccgcccggtgggcacaagcgcttgcgggaggaaccagttgtcggttttttatgcgggctcctcagcaccttcgccacccacccacactccgcgccccgactgcgcgaagctgccccgtttaggcaaacggggcccggccggcgcgacgcagaagaataaagcagactccgtcgtttcttctataatggagggtatactcgtttattgcgacatcacaccccgtgttgctattttaaattgaaggccgttgataacccgcatcatccactaacgtcgttagcgataacgattgtatcttcccccccccccccacctacggtttgtcgacagctatgataagcggaggaaaacctgcctgattccttgggcggggatccttgtgcgctgtcttgctctgtatgcgccgacccaaagccgcctcctcctcaacgtaaatttaaccgcccaggccgcgtagttgcgtgtcctgaacgggaaagaagttcgttcgctgttattgtggtcattaccgtaactgtcccggcgtgcctccatctgctgagtcccgtgcagactggcatgaggatggttgttcggcggcaggcaactcccccctcatccctactaatcccgaatgcctttaatgatcacgcaataacccctcctcttaacaatatctctttttcgatgaagatttcagttcccccataacacggcagaacgagtctgatccctgatcaattggaacgacttccttcttcagaaaggttaaacgaggacacagtctgcgacgagagggcttaacacttcctcctgtgcgagagcgcgtctctgcgatgtggcttcgccgcaaagtcctttcccatactaggcgtaaaccgcactataacaactccccctccccccagcacccaaggggcccgtgaaaccgcgactggtttcttcttcactggctcagtactgcaaatgtgctgcttacctcgtgattgctgtcgtcggggctcgttcgcactttccaggccaccaaagaaagcgagaccagagccaatcgggaccatctccgaaccttgttcgctaccacacacgtgccgccctttgttgacgtggccgcaaacagagctcgtggccacgccaacgaactgctcgtcctataaaacccctcccatactcaatgccccctgaaatgtttgcaggggggaaagtgaagccttctgcttcattcaggtgttcgcaatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacaggaaagggagacgtgaccgcggccgtctctcccggctagctccgagccgaatcgagaaggggctgccgccggcaccgcgctcctggtaggtgctgtcgggtcgcgcgatcgcgtggacgccggtgcgttaggggcaagtagggccggccccccctcccccacgcagcgcctattgccccgtcgcctctctttgtccctgaccccgacgcgaatatcggggggggggggggcggcgcgggtcggggaaagaggtgggacgtgttggcgtgagcgttgggtgcttaataattcgctctgtccggccgtcggtatttctctcccaccaccaccccctccatttctctcctcttctgtctccaaccaccaccgccccctccgtttctctcctcttctgtctccaaccaccaccaccccctccgtttctctcctcttctgtctccaaccaccaccaccccctccgtttctctcctcttctgtctccaaccaccaccaccacccccccccccccccccaaaaaaaagaaatacacgcgcgcgcttgactttttagagccgggcggttcgcccgagcctaagcgtctcgatgctcaagggccggtccgcttcgggttctagcccccgggcgagcactctcccgagggcggtaggaacgtcgggagcgagagaaacaaaccgcacgaaccgcacagtcgctcgcaggagcgtgtcgagggttaatgtctccttacctcggcgtcgctaggagaatgtttgcccccggggagcctagcagcgctgaccgcagcatatctaatggcaaaacctgctcgtttcgcaatccggccgataagcgtttgtttgacaagaaacgttgtgggcggcggaatgtttacctatggggctcggctgattcggagagcagcccggggatcaaatcgcgttgatgggagttaatgattaaaggagtagccaggccggcactgccggagccgtggctgtggtgtgtgtaggggcggggtggtggtggtgttgggcggggggcaagaagcgatgcgaactgcggggaacgctttctcacggttccccctcatttttttcagagcaggactccttccgcgctccctgcgctggtccccatccgcccgattaacccctgcatttacgcccctgtaaggagcggatcgccagtgctgccggcgtcgccacggttggaccggcgcgcgtttcccccattgctcggacatggagaacccgcccgatttctacagcctgttagagatgttagccgacaacggcggattttctccgcagccacccgccaccccgggagatccgtaccaggacgtgtgcttgaatacaccgagcgtggccgtgcccccgacgcccggtcggcagcccgtcccgccacggtctaaatcccctgcccgcgcggctcccgtcgcgggcagccttgccggcgcacgagcccctttcggcattgagggtgccgtttcggagggttcggatacgggtctccgttccgccgaaccccccgacggcgcgcatcaggggtctcctggcgaggtcgtcagttccaccgcggacatcgtggacgtctgtggaaacgaaacggccgcggcggccccgcggtcctgttcttggcaaaagacagtcggcgatctagtccccgcgggttcggaacggggcgaaccgagccctatggatccccgcaaatcaaacgaccccgtccgctgcgtatctgacgcgccctgtaagcccaccggcgcctgcacgccgctcgccgtctgtgtcgaaactctcccccctccctcgggcgtgccccccccacccccccccgaacctatcgtgaacttcccatggacattttctccgctgacgccgggaccgttcgctcaacaccattcacccactccccctacaccacctccccttagcccccctcctcctacgccacccccccttagcccccctcctcctacgccacctccccttagcccccctcctcctacgccacctccgcataccccccctccgcacggttcccctccccccacgcctctgccgtctacctcccctccctctacgcagacatcctccccgtctgcgtctctaccgcttgactcgcctccggcgtctaccccacctccgccaacccctctccacgacaggcctctttccccggaccccccagccctctctgcttcttgtcagcgtccttcccctccgttgtccccttcagccccccgcctcgcacccgctcccctccggagcgaccgagtcccagcccgccgtaaatcgagcgtttccgagggcgggggcccccgtaccaggggcgcgggcttccagtacgtctgccgcctatccgcatccgccaggatcccatccccccctcgagaagagctcgagttggtggcccgccagccggggagccacgctatgttgtggcgcgcgggggctcgcgacggcgcgacggagccgtcctccggagacaaccctaaggtttttctcctcgcgttgtcggacgctcgccggtgcccttcctactgggatcggctggcgagggaagcggtactcagagaaatcttacctactccgcgcggcagccctctgcggacctcaccggggtctatcgaactgccgagagaggcccctttactcgacagcgactaccggccgttcgaatggcgttgcgcgaagggtcgcccgctgccccaggagccggtcttcccgtgccctccgaacgagctggggaatgactgggcggcctgcaagatgtggttgttttctcgatgcgcgcgcctcgttctctcgaccctggacgatatgtcgccgtccgaggacggggaaagcgtgttagaatcgcagggttgcggatggggcccgcagaacgagtgcccgctccccctccccgccccgatagtgctgccaacgcgcatctgggaagcggtaacacggctcccgagaccggctccgcgcaccccgacgtacgcttacattttgtcggcgctccttcgcttcctcggccttcaagtcacccccgatttcgtgtcgaaggttccccgcctttcataccgctggctggaccgactccgctgcgtcaggcgcgtccagtacatggcccacgttctgacacgcgacttttcctatcaattacaagcggctcgtggtctgccgtgctttccggcgtgcgcgccgccgccgggcgcgggtactcccttggacgaggactggaacggaacgccgccctctgaatccccccgcggtctcgactgcagccggcgccgcggcggcttctatgcctccaacttctgtcctctgctcgaggagattcggtgggtggaaggccgggaaggcagcccgaacccctggaccgggctcacctggaacgatttcaagatgctacattacaggtgtctttttttcaaagtgcgtcgggggttactgctggccccagacgactacatcgtcggccccgacgtgcggcccggcttcgaggtgcctttcgaaatgccccccccgcccgccaccgcgctccctcccgcgctttccgcggccgtcagggaatcgaagttggcgctgcggaacggaaatccggaacccggcgggacgccccacggctctcgtcccgcacgcgcctacggattcatggtgcagcagctcgccgtcgctatggtcgaactggggttccccgcctgcggtccggccatcgaaaaacgggtcagacctctgtacaaagccatacttgattggcgcgccgccgtcaccgccgcggcgctacgccgattcagacacctccgtcagccgtccggcgcgagggacgacggagcgcccatgtttcccccccttcccgttccagactggaacgggccgtctccgaggccgggcctcgttagcagccccaccggtacgcaggaacgttaccgcagagtccagccgggatcgggctccgatggttcgcacacaacagctccacctgctgttctaaaacaggcattacaacaggaggttggcacgccggcgacccgcgcttcccatcccctaccccggcctcccccggcctcgtacccttcgctcgggtgtcgctccagatcttcctcctcctcgtccgcttcctcttcctcgtcctcttcgtcgtccgcgccctcttcatcggaacagtcgtctgccgccccttcttcgcgcacctcatccaggtcgccgacccgcgaggcaggagcgcctcaatgcgctgccagaggccgcggccgcggccgcggaggacggcgcggccgcggccggcgggcgccatcaccgtcctcggaaactgctgcgccgccaccgccggatgacctcgaccaagaggtgtggtggcaaattccctccccgccggccggccggtgctggttcgggcctctcggcggacaccgacaggcgctccggggcatccctgaagtagagcaggccgccgttagattcctctctactcccggtcccctcccggtgtacgtggaggaaatggggaactgcgccaaacagtacgaggcgctcgtaagcgccatgcttaacaaagacgtgaaggcgaaccccctgaactgggcacaccacggcaagctctcgcccaccgacgcagcgctcaatcacatctatgtcacgaagtttcagagctcgcacagttcgccgggcgcggccgtcacggggacggtcaacaaatgcataccccacatagccagcgccatgaagaagcgaaatctgctttgggcgctaccgcacatcgccgccagcgtgtctatgactcgcaggtactgcaaagatcagaaagagttcatgttccgctccctcaggaaagcctacgcgcctatggcgtctgcagccagcgccgaaatgcgacgcccctcggcatcgcctatttcaaatcgggcacccgtcactgcccaaagtacggcggccgggctcatcccggtaatagacgtgtccacgatccacgaccgcgtgcgccggggcgtcgcggccttcaattccgcgctagaggagggcctgctggacgtccccgaataccgattggtcgcgcccgcgcgtccggacatccctgccggggacggtttcgcgtctacccggccgctgaacgagctggtggacgcttgcgcgctggagtgcgagggggtcgtggcggcgcttctgcgcggacccgacggtccgggcgcggtcgcggaaatgctgtcgtcttgcgaggacgggcccttccctcgacccgccggccacgaacagtgggaaaaatgccgggctctgctcgggtcgtggctccgagacctgcttgatctcaggagcgccgtgtacgcggcctacgcgaacggttcggctcctcgggggcgccaggagcgaactctcgcggctaatgcggtggccctgataacggaagcgatcggcccgttgcttagcaaagaccccgctcggccttggcgatgccctgggtcgagggacattacttccgtgctcctgcgcgaatgtgggtcgaggggcgaaccggtacgatcccgcgagaaggcccgacggctgcaacgcgtggcgcgccttctcgcggacgccgacgcggcctcttccggaacgtccgagggccggtcgcgctccgcggagccttgttacgaccccggccccgcaagttctcccgagcccgtgcgggccctttgcgcccaaacgtcagccgagtcaaggaagagaaaatcagctcccgcggcggttctcgacggcgcggacaacgccgtcgagaacccgcgtccgcgtttgggaaggtcccggacaggcgccggacctccgcctgtcgccagctgcacaaggccccccaccccccctgaagcgtgccgcgacgccgggcctttcccgcccaagcgcccacgttgctttccgtggcgcgaccccgcgcgcattatggacggttccctgtcgttaggcgatcgacggcatcgtggcgccgcctttaggaagccccccattggaactccgattgctggctatgccggccccccgcacctcgacgcctattgtccaggcgaaggagtcgacgagctgaccagcttcgcccaaataccgactctgtggcgtcagccgttggcgcgttctccggaggccatggcggagatcgctcgcgtggcgagcactccctcgcacgtcagcagaagcccagacactgctgcgtccgagggagtgttgtgccgcacggccgtcgtctctctcagagcgcgcaccgcttggatgcggcatcagcaggcttcgcctgaagatgtcgctctcgtcatcctgtacacggccaacccaggcgagcacctgttttgcgtaccggcgcccggctcgccccccgggggaccccggttcgacccgaaccggggaggactctctttcctgctcgccgcactcgccaaccgcctctgcctaccggagagcgccgcctgggcgggccggtggagagcggcgccggacgtttcggcgctgaccgcggccggcgtcatgttcctgtcccctcaggacctcggttttgcgggcgtcctggaacacctgcaacgcctctgtttgaaacgagaaaaaaggctcgtggtcctggacacgctagaggatcaagatcgcccggagaacggcccgcgcctcgtggaagaagccgtccgctacgtcaggtgcaccgtctcgccccgcagccaatgctccgtccgatggcctggccaccccgatctagctacgacggtcataacctcgcgggacgtgctgggccccgtggtcctacgtgagctggaaacgcactttcgccgcgaaaaccccgcggccggcgacatcagtctgtgctgcggaagcaacgtccgatacaaggtcgcgacgcgactggaccgcgtcgcgacggtcccaatgaccgctctctcctacctcgcagcctcctcggcccttgtggccgggcgccagaggccgcccggccccgactttttagctggagagtcgcactcccaccgagccgctctcaagtggggactgtacgccccgctgcgtcccgtgtacgtcttggagcccaaaaagaacgccatagtttcccccgatttcttaaataggaccgtctgcgacgtttgccgctccgtagtcctcccccccgatccgcacgcccagccagtcgtcgttcacgttcccgaagcgacgtgcagtttattggcccgcgagatgctcgctcacctacgtagctcgtctgtagtgtggctggaaggggacggcggtccgccggagaccaccgtccaggaggaacagggcgcgcgacagaggataattcatcctccgacgctgcccggtcctccttcgcccttggccctcagcgactctgaagtcttcggcgagtgaaggctaagtcagggtcgggggggggggggcggggggagtcactcggcggacttttaagggctatctggacaagcagccccgcgggtacgacatatcatccgcgagcggggagacggacaaataaattagggggccagcggaaccccgcggctcggttgcgttccgcgctgttagtcgtacgggccgcggtctgccgtgcggatgcgtcaccgcctggtccattggtcggccgtggccacgcctctatacctgttcccagaacgaatgccccgcgcgcaccttcgcccggccattcagtagcgcagaagcgccggcgagcccgcgggcgcgttcgccgtagtgttctcccgcaaacgcggtagagaaagtttcgtaaaaggaagaccgcgcggcgacagcgcctagaagacccgtggcctgtacgaggaggagcggcggcgaaagcggggtcctttcgccctgcgctccgccaaaggggggaggggacggacaatggagcctcccacggcaaagtcggacggggccgcaccggatcccgacggcgacgtgaaccgaaccgacccgccgctcattgtccctcaagcctcagaactccgccctaccttctccgaaagctcccgggggtccccgacggcggtctgcccgggaaccgaaaccgcgggcgcggagccgtggccccctggactcagatcgccgcgtcctttccgaaggcctgcgcggctgtaccgaagaatcgcgatccctagggctgcggaaaccgctcctccggatcctgcaacgagctccgctccgtgaaggtcatctcgaacggatagaaccgctcaaggtcgggggggggggggggggtggtggtagggttaacggtagctgggattgagatgtagcgctggcgaataaataaataaataaatgaatgaatgaatgaatgaatgaatgaatgaatgaatgaagggaccagatgcgacagacatcattcgcgctctctgaccgactcttgccggcggcggcagggggtttcggtcgccctgggtggccgggggggggggggcggggggtgcgtccggaggcagcggcgcgcggggacacctctgttcttacgctgttcgcggagagccctctaccccgcggatcgatccctcgcgcgggagcaatctctgcggtcccctgcgcagcccgcggagcggttcggtccgcggcgcgctcgcccgctcgcccgcccggctatcctcttccgcagcggcaccagaaagtggcgggaacgagcgcgcatacgggagacataaaaatggcgggggagacgggtttctgatcgagtcggcgagcgggcccgaggaaagcggcagcgggacagggtttccggatcggaccgcggcggctaccgaggcccgctgtcgcactccgcggtccctaattgttcgcccgcgcacccccctcccccaccccattcgcgtcggcgagcgggcccgaagaaagcgcaggggggacacggtttccggatcggaccgcggcggctaccgagtccacctcgcgccccccgcggaccccaatcgttcgcccgtgacggtctctggactgttctgcccctccccctttcccccaccacccacgccgcagacctttttcgagacgaaccgcggctgtcctaagtgaccgagacgggcgcctgaaaaagccttgcgtctgatcggggggggggggggggcgcgactccaagcgttagaccgccgaccgccggcggctccgcgcggccagtaggccgagccgcacgctgcatccccgccggacatgcccgccggccgcgcgggcgctcgctaggccgcccggaaatgcgtagcggacccgtgcgcgcatgcgcgcagtcgacatttgcgagcatgcgcgcggcggaccctagcgagcatgcgcgcggcggaccgtagggagcatgcgcgcggcggaccgtagggagcatgcgcgcggcggaccctggccaccaccaaacgtcataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggct

SEQ ID NO: 22 - DNA, 169667 bp, unidentified
  source 1..169667: mol_type = other DNA; note = Genoma completo del virus rSB1-ILTV (gD-I)
ataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggctgggccgcagcctcccgccgccacaggtgcactcagcccgcgggctgccgcaccccgcgaactgtcggctacaggcagaatgaacgcgcagcattgcgcggacacagtgggtgaccgaagcacaccaccacagactctgaccctgccatagccccgaccgtgaaatgaggcccggcgaggcctaacagtcaccccgaccgtgatacatgacaccaacgctgcccgttacattaaaaggtcctagccctacatgccgtaaccgccaaagccgctacccttaatatgtcctgaccccgactatggactattaccctaaccctgaaaggccataacagtgaccctaacagtcctgacgccgaccccgagaggccctaaccgccaccgtaaacggccctggcccaagcccttaatgtggccctaacaggcactaaaacgaataagacaggccctaaccccgaccgtgatgacaggccgaacccccgaccctaacagaccctatcgcggggtccaataatccgctttcccaccccgtccttcaacggaagagtgcgtgcttcagacccgcggacccgggcaacttgtacccggccccgagcgtctctgtgcaacgcactacattgaaagtaaacaacaggtaggcggtgtcgactcaggtctgtgcgaacgccaaccgctttcaagaacggaggctacgcgcagtcacgaatgaggaagtggttttgtgaggccgatcccctttcctgtttttttgagactcgcagccgattccgagaggaccgggagcgcacgacgatgggctcccgccttacagttttctccgcgaacaccgtactcctgctgggaaggtaagccgcggtccactgtttacttcccgtgcaagcacttccgcgtacgcgattgtccggcacgtccggacgcgcttaatttccgtgtcctgactgcatccggcgactacagcgccgcatccccccctcaaccccccccccgtagattccatggccgagtccgccacaccggctttttggaatttcgcggggggctggcggagaccgcctctgtcccggcgctcgggaagtgcgtacaggatgtttttctttttccggcagcggtgcagcaatggcggggacgcaggacgcttgggaaccgcggaccgcagcctttgcgtcgccgccgggagacggcggcttcatcgcgcacgcgggcgctcctagccccgacccgggctgaagccgtcggccagtacgaataaaaacgcccatggaatgctgctacgagacgcgtccgtccgtccgtccgtctggctcgcgcgcgagcgcatgcgcgcacatccgccgtttccgtaaacaccggaacgacaccctcgccggccccgaccctcaatccgcggcacgccctgaccctataaccattacacgccccgccctaattccgagagaccttaacccctaacctaaccctgttaccctacccctaacaggccctaaccctgacggggagggggaacgcctccttaacagactaacaataatggggggggggaggagggtcgctcctagccctaacgggcccaaccttcgcgcctaccctacccctgccaggccctaaccctactcgggggggggaggggggatgggaacctaagcgtggcaggtcgaaccgtgtggggggggccctgcccgtaacagaccccagcccctacccttacgggccccaacccttacaagaccctaaccttagtactcggtgggagcctaacccgaatagggcctgacattaataggccctaataacccttacacctgtgaccacgaactctgataggccataaccctgaccttgacaggtcctaaccccgggcccctaagccaaacgccgcccttgagaccctaaccccgaggccttaaccctgacccagagaacctaacactgataggccttcgcgctcttagtctctgatcataatcaccccgaccctaaagacccgatccagaagcctaaccccgaccctaaagacccgatccagaagcctaaccccgaccctgaccctaaccctgcccctaaaggcctaaccccgaccctgcacctgagcttgcccctaaaggcctaaccccgaccccgacactacccctaaaggcctaaccccgacaacgacactacccctacaggcctaaccccgacaacgacactacccctaaaggcctaaccctaaacccgacactacccctaaaggtctaaccccgaactcgacccgacccctaaacgcctaaccacgaccccgagactgcccctaaaggcctaaccctaaaccagacacaacccctaaaggcctaaccccgaacccgacccgacccctaaacgcctaactttggaccccaaccctaaccttaacggcatatccctgtccatgaccctgacacccgaccctggcactaacccttaccccgagcccctgcccctaagggcccaaccatcaccctaaaggcccgaccctgcccctaaagacctaagcatgaccttaaaggcctaaccctgaccatgaccctaagggcccgaccctaaccctaacctagtaccctccttccacaccccccccccgaaaaccgagcatagcccaacaatgaactcggccggtttaaagatttatttcgatgcgatgcgcggtcacgcccaccacaaaaatagaccctgcaatattgatgccggaaccagcccatcgcagagcgggcgaccgctacacgggacgcgtattcgtcgggaccgcctttctccggcaggtagcctacacgtacctcactatggccataaagatgcagccatagagaggtacgtgaagaagacccgtcggaatcagaagcaacatttcaggacgtacgactcgagccggacatgataccagacaccggagtccacagcgaccgcgatttcctctgcgcctaccctcggccgacgaacaacgccgagggtaggcgtcgagaaaatcgcgaccgagggtgcgccctcgttccacgcgatcccgcagaacgcttcgcgcccagtctccgtccatcgacgtggtgcttgatgacaggatccacctctaacaccacgcgatgcgctccgcagcgccttcgtcccggagtagagcgccatctccttcctccagcacggtgctcgacgcggcaatacaaaagtctcacgcctcgaacaccggacgaaggagggaactgcgcgcgtctggactttaccggggcggcttcgtcccgcggcgttccggatgacgtttcgagggcccactccatccttcggtgcggtgcccgagaagggatgacgacctctcacacacagcacaaaggacggcgctgggctccgtccgatgctctcgatctcaggcagcacggcaccgatccggagagcgcgtcgcacgtcgcgtcctacccccggagtagtgcatgacggttactccccggcaagcactcgtccgaaggaggacacgccacgcgacccgattcccagccgcttcgcgcccggctacttcttcgcctgcagtccgccggcagggctcgagcaaacaaactcccatctttccctgacggcatctaaccgttaaaatacgacgtcaggcaccgtaagggaaaaaatggaagcagttcggagtacagacgcctaaccacgggccctctctcgcccctccgcgtccgatatgcagatcggtgagagtactgatcgtctcatatccgcaacgaagacttcgggatcgatagacgttatccttcccgcccccccccccccacataggaacctctgttccatcgccatctgttacaaaaaagggcgagcctatccactggcaacgagcgagaacacagctaggcctcccaggtcgtaacaagccacttacgtcgtcgcgggggaaggtcggtccatttcgctcctattccgcaccttcgtttggaacagaagcattacacacaccgccatttccccgcgggcagaattctagtctttttgtggttatgctcccacctacccgcacagacacgtactcacctctcacgatccagcatatcgccgtaagatttacagacattcctccctccccacccaaccgaacactgcacagcggcagcctaaaagtcgctctgcggtcgcatatcccccccaccccccttcgatggtccggtgtacggagacctctcacacaacacaggacaccgtaccacggaccatccgaacggcgggcgaacagtcacgcaggacgtggacacgagtcctgcgctcgcacaggcagctgggcggcggtgctgtcttcctccgacggacagcctacaagcaagccactaggactaccgatacgaccagagtgacgtgcgtgtaagacggcccaggacgaagtcccgcgccccgccgaaaataacagcaccgacctgaaagagaccacgtcttacccaacagccgacccccgaacgatgcacgctcccaagagtcggccgtaggagagcacgcgcccccccatactcggcgcgcgtacccgcggccatccctgcagcgcggcccggcctcgttgcgattcagtgaacgtaccgcgcgccatctccgtccatcggcgtggtgctcgatcccgtcattcggtgatctcaagcaccccgcgaaggaggaagcggagcgtgtaacgatttccgcggcgcgcgacgacgccgcgccgtcccgtccgacgtttggaacgccgcctcggtccttgcgcgcagtacttgagacgatacgtgttaaaatctcaggcaccacgctaaggacggagcagagctcggttcgcttcgctcgcgcgccgacgcatctctgcttcgcagaacctgttttgaaaagaccgcagcgaccaccgcgtgctaccctcggaggggggcatgaggacggcgcccgatactcccgtgcacaccgccgaggggggacacggcgcgcgcgccgatgctcagccggttcttcgcccagagccctcccaaccttgtcccacacgacggggagcggcacggggaatcaattcgtctttctctccgcaggcattgcacaacggcaatgacacgtgcaatgccagcctgagagaaaacatacgaacagtcccgagttccgagtagtaactctcgctttcgcgcccttccccgactcgttccgagcatatcaggcgatacgaggcatttcgcgcgcgtcgccctgtccgtcccggttgtcctagaacgtgacacctctaggggacccgggaaggactggacgacgcgccgtcgtgcggtccgaccgcaatacggcgtcgttaccccttcctcacaacacctgatctcgtggcctaaatacccgctcatcgccccgcatccgacgcctctacctcccctttgtccccaaccgagaaacctatccggggcccgctaaggtcgaaccgccgagactccgtcgtccggctattacccgccataacaagtcgctagtcgaaggatggaatcgcagcggtccgagcggctctcctctgatatcccggcacggcctattgggattaaggtccgggcctattcagattacggttagagtcctcgagaaacatttcagtctctctggcatctgacaacggctacgcgccactcagatgccaaaacagactggatgcgtttccaaaggccatcgtgtctaacaaaggccagtccctgtaactaggccaaacatctcatcaccgtccaagtcacaggtacttcaggtttacggtcgtctgctatctacaacgaagaattcagagccgatctcgccagggccccttctcccccctcccttcttcccccctcccttctccccccctcccttctcccccctcccttcttcccccctcccttcttcccccctcccttcttcccccctcccttcttcccccctcccttcttcccccctcccttcttcccccctcccttcttcccccctcccttcttcccccctcccttcttcctcccttccccccccctcccctcttcctcccttccccctcccttccccccctcccttccccccctcccttccccccctcccttccccccctcccttccccccctcccttccccccttcccccttcccctcttctcccccccccctccccactccctcccttcttcccccttctcccacctccgttcagccttccccctcccccctcccttctcccccctccgttcagccttccccctcccccctcccttctcccccctccgttcagacttcctcctccccaatcgccccccttcgcaacttgcgaaatctagtctaacacgggtttacttacgcggtttacattcacacagcgggtgcatgttttccgctgacatttcccaagccggccacaagaaacgaagcaaaaaaaaaaaagataggggtattaatgcgcgccacccgtcgctacgcagcccgactccaaatttcgaataatgcccttctaggcattggaccgccgccccactccccgcgcaatatctaggcttaatcgccaagattgaccacgtatcccttatcgcgccggccgttcaggccctccccccccccccacgcctctcgactcttttttttttccatgggccgtccagactgagacgacacgtagattcgcggtcgtcccagaataaaggatgaccccgcgatgcccattcccactcgcccgacgtctccctccgattcaaaagtactgcggcacgacctgcgatggaagggaaaaacacaccaaacggccttaagttttccggtttgcctttcccttccatcgcaaatagcccgcaaaagaaggatcgcatttccggccccgtccggccatcgcgactcatccaccggccaaacggggatatcggaccgcgagactttaacggctatgtatttccccacccgctcttctcagaggaatccccgatgcaatctagaagcttatcgttcagagcgtttcgggcacggaacttcctgagaatatagatcatctctcagggtgcaccgtaccacacaacgtttctgtgggaaaacggaaggccagtcactttcacgtagacccctcaggatacccataacagaaaaactcagccccccctcccctcacgaccattttcctacgtggaatgcactacaagtacctgacattttgcaaacagggcgccgagacgtccgatggggttccagcttccgtggcggacgaaccaacaccagtgtgggcgttcgcatctccccccccctcccccccccccatacatgaaagacctacgattactgcataggaccccgctcctgggacaaatactccggaaacctccagggatcggaaatttatttagaaggggggtggggtacagggcatgcttgcttaggatctgctcgaaacttgactataaaaggcaatctgactagaatcgccaaaggcgataggtctcagaagaaaagtaggacgcgcgggggagggataattgtttacgcgggggggaagataaatggcccacggcggaaacgagaaagcgcgggggggggttaggccttggaagggggaaagacgcattcgcgcatgtcagaattaagatggcttccctataagacgaacgcacggtttaacagaaaagcggacatcacgccggggtcgaacgcgggaaaataaaaccgttgcgggggggggggggagtccgaaccgtgcggcgggaaggctccgagtccgaccggaaacggaaaaaggcggcacggcacggggcgctcaacgcacaggggataggaagaatttcccctcggcccgcggattcggatcgcgctcgcgatccaccttttctccgccgactcgccgaccgcccggaacgccggtacttacgcgctggagaagccccgtattactcttcttcccggattcggccccggcgcttctgcgtctgcgcggcggacatacgcagttgcgcttccgtcgacgtattcaatgtaaacaaggaagtcggccctgcgacttccgcgatcgcgatcgcgaaccggtaaacaacgcagggggagcgcggagcgcgggcgcgggcagggagttaacctcgcgatccgaccgcgcattcggatgtgcgggtcgggggcgtagagataacgcggcgtttccgctccgggccggagaggctggcgggcgggtctctccgtacattctttttttttgcaaacgcgccgctgcgcgcctaaacgccgcagcggcgcgaaacgcccgcgctctctaagcgtccgaaggccgtacggacaccggtgcgtccgggcgctcggccgggcgaacggcggagcttttctttctcttttcagtctcggagaaaacggcccggtgcacacctcctctcgggagcgtcgcaggaaagtaagttcgtgtcactcaccacccccccccccccgccatcgacacggagtctgagcatgagggctttaataaaccgatttgaacgtgctacgacgagagtccgtgcaagtgttcgcgctcgcgcctatacgtactacgacagccgctctgtagccgcggtgtgtgtgggggtgtgtgggggtgtgtgtgggggtgtgtgtgggtgtgcgcgcggccgggacgggattcctgattccgtagcacttcatctcgaatgtggaattcggttccgacgggggccgttaacacatatacgcgacactggtcggaactcgcgacttccacggtcgccgcgtaagtcagtggtgcttatacgtgggaacgaagcgaggctaagtagcaggtcgcgaacaaggaggtggaccgcggggctgtttatatcgcatctgcgtctcccgcggggccggtgagctaacggctcctccccgtcgcgaaactgtatcccccgcacaaacacctggacgatccgcgagcgacttatgatgcgcgtgcccctcccccaactaacccttcgcgcgcaccgcgggcctcggcgcggtacgttctccacaacactaatcgcacgcattcccggtcgcccgtcgccccccccctcgcacatcccgcctcgggggagaggagaggacaaagtacgttccccgacttacgcgacggactcccccgcccgcgccatcgccagacaccgaaacgggaccgaagcgagaaagactttttaataaacacgttcatacgcactacgacgagaccgctcgcacgcggtctcgtacacgcacgtacaccttaacgatcgacgcactgtacgcgagggctaagagcgggcgagcgatccaccccgtttcgcaagaaacgacgcgtcccgggcgcggctccgctaagcattcgtttacacggcagtttcggcgtctccctcctccggtcgtccgtaggagccctctgcgtttccccgcacggccctcgaaaccaaactccacagactcttccagacgtttgcgacgctaggctggcccggggcgcggacgcggtctgagggcttgagccggtggctgcagctcgtgagagcgtgttcgaactctgaaacgtaaaacggtccggctcgattccggataacgcaaacgtcttttcccctcccccccgatccggcaggcgagaccttcccactcaacctcggtcccgcacgggcttgggggggggggggggagggaaatagccggccgaaccctactcgggcccggacccaaacgacatcgctccaaaagagagcgttccgtttgacggagcccgcggtgcgtacctgcacgggattccggatcccgatcccatagcgaccaatctcgaatactgaactccgttgttccgtcggaggccgttaacacatataggggcaattggtctgggctcacgattttcattgtcgccgcaaaagtgagtgtgcttgtgtgtgcaacaaagcgagaccctctaccctgttcgtgaggagagggtcgcggggttgcatatatgtggcatatgcgttgatcacgggaccggtgagctgacaactcctccccgtcagggaactctattccccgcattaccacatggacgggccgcggcgtcgcggcgtttcccacacccctccaccgaccatgccccacccccgctctcgttcgagaggccgtcccctcccccatttcgttccgcctcgtccagagccagcgcgggacttcactttttccccatccctctactcctatctcgttgcccagcccacgatcgctatgtacgcgttctctccgaggccggctcgcgccgagccggccagacaaagtcacttcggaactgacgccgaagtgagtgctgaacggttgagggggcggcgtatcgcggataagctattctcctcggagtctttttgcggcaggccgcaagcttcctcgtacccccctttcggggttcgctagaactcgatcgaaacccgagacgagttactactgagccgatccctacagctcgggaccgctcccgaacagaacgcggcctcatcgggttctttcgtagagcgccgcaagggcagaaacggaccgacgcgcgtccgagactcatcccgagctcacgccgaacggctttattgctccgcttccgaacgagagagcggtcctatctcgaccggcccgttttcaatcgattcccgaggttccgacctcgccgcgggtgcggggccggggggaaagtcggggggcgacccgcgaccgtgttccgcgagcggcgttcggccgcgtcgccgacgcggggtcggatctcgttctcgtgcgagggatcgggacgatccgcggacgagaacgatggggcgtcctccctcgacgtccgacggttccggacgccgcgagggtcgcggcccgaaggcggagatgccgagctcggccagttcgatgccctcggtacccatcccccttccacccgtcggcgacccccgcgaacgcgagccgtagacgacgttctcgggacggcgcgcgatcgcttcccggccgcctgcgatcccaacgggacgggttcgttcgccgcgcggttcgcccggcggtaaaagaacgaccagaaaatccgatccgcgacggcgggcgctttattaccgcggtcccgcgctttcggacggcgggccggccagcggaacgacggtccccgccggacctccgctcgcgtatttgtaggccggaggtccccgaatccgcccccgtgggaggggggcggcgtttctagcccccggcgcgggccgcggccggacacgaacacgtggcataggatcccgcttcccgattggcccggacgggcgttcgcaccttgcgccaataatatattatatatataatcttatattggttcgcggtgcgaacgctgacgcgttcgccccgctcgtttgcattgcatcacgtgatcgttacgccctcacgaccggcccggtcataagaagcggaggcgccggatctccgcttagagcgccggtccggcgcttcccgcgaacggacgcaaggtggcggcagaggataagcgatcgccgaacgagagccccgtcgggagcgatcccggatcggacgccgcggcgaacgcgtaggtttcggccgtctcccccttcccttcccccacacatcctcccgccccccacaacctcctccccggcggcctcggacggcgcctcccccgctcttcccgaactgcaggccggccggctaccctccctcccccctctcctccttccccccctcccccttcttctcccgtccgaccggcccggcggaacgcgatgcggcgggggaaaaggcgccgatccgacggacgcgatcgcgacccgaccgctgatccgcgcgcccctccggacgccgagagggatgcggagcgcgagagcggagccggggacggagggggcgacccggacgccggagagaacgacgccggagggcgcggaccgggcgcggacccgggcgacgacccgggcgacgacccgggcgacgacccgggcgacgacccgggcgcggacgcgggcgcggacgcggacgaggcgcacgcgcgcctgctccggcgcgccgagcgcgaaaacaagaaactccgaaggggatgtaatttagtgtttactataagcaacaaaaccctagtagtcggaacatgttttatgcttgcggcaggtgtactagtcggtgcaagtggtgctgaccacgagactgcatgcaacaaaactaatttgctgttggtatttgttactgccctcttgacacgatttatttgaaacggtaacgaatgctcgtgtactttataattgcatgcccgattacaatctgttctgtaagaatagttatacgtagcgtgttttacatagtcttcgatgtatagaagagacgcagtcaacttgccggtgccgtgaaattgtctccacactatgatgtttttactgttacaaggtaattaaagaccttcgagtttttcactccacttgtgtgacgctccttcgattatgagagtacaatgtcgtctaagggggatgtggatcaccacgcgggttatggggtggcactcgcaattattgctctattgctcgtacatgctactgcactgattatggtgagtgtctttttacctctgtcccatcagtaattgctaaacaatgattgttttaatgccaaaaatctttttttagatcttttctgatgtcaaattcagaccagtttcacaggatcttagtacgcagtacccatctcataagcattatgatgatgcgtactcgccacatatgtctggggtagaccacggccattcggatgtatggactaacactgtaaatgacccatccggcggaataaactcaaatttgcctggtgcgaagagcgtggagaagatctatcctagcgtagaaccaagtacgtcgcatgacaaagtgtcgtatggaaatgcatggggaggggacataaacaccggcagtgtttcaccttctgatgacaaagcattgcccgccactgtcgaaccatcgacggacatcgtttccatcgcgatcacggggagcagtttaaacggagaaagtagttggcggatttctaaggatggcccgcgtcgggtttatacaccacaccagactaaaagaagtcctcctcagatcgatggcacgcgtttatctactagaacggcatacttgagtgtgtgggatgaacaggaggggatttttaaaacgttcccggccaatgctgctgcattcaatttattggacgctaatcagttagagaaagcgcgccgtgaagtttttttcgttgtgtcggtgtggcatggaaatacgaacgaaacccgtatatttttatccgccacgaggctactgacgcgaatgatgtccacatcgctcgtcgtttatctttcctgggactctcgaggggccctggggacgacaactgatgcggcttttctggcacggagcgtaaatatatcccagttcctgaccgctgtaccaccacattcgcaagttcgttgtatgggccattcattaggaatgtatacttgcggttccatctgtagacaatataatagtgtaggtacgaccagatgcaaaagcattttaagtattgatccttacggcgcctcatcacccgagtctcatgtatcctcggcagacagctcaaatacaatacgctttgatgccgactatgttgcgattttcgcaacaagtaagtggcacttgaacacgtccgattcaaacgcagacgaatatataatagtagatggcttgaatgcaaatgctgtgtgtgtcgatccctacgagtggagtgtcttattgtgtgttagcaatcgccaacgaaatgccgtttgtgagcgattcggtgctaacaacgtaacgactaccggcgaccctgcggaagacggttcggaaacatgcatgcgaatactccctatactatcggtgctgcagtcgctcgataagaattctgcgtatccgctgttacgtatggatccgccgggagcttctgcagcggtaccatccttaccgtccacatggaatatctacgtgatgggaaaggattacagatattctacttatggaaaaaatgagagcctgtggtattctagcgccgtgcatatgggaggaccgggattctttcctgcgtcggtatttactgtgtttcttccctcgggtatacccgctgtggtatccaatgtcgtgcaacacagtagcatcagttacggagatgtagcggttcattccgctttcttaactgataggtccctctactacccccgagtgatggtccaaacatccgggcctattttatctgcctattcttggagagcgcgactgcataatgacagcctctatttattaccacttccagaacaggagataatgcaatacaaatgcgcagttgcacagggaagctatgcatgtagtcccacaggcccgatcttgacaactgttatgtggcgttcactgttattcgcgggcagatcttcgccggtgcccccaaacggtagttgtttgacttatatccccgctaacacaatcatccggagccggtcccccattgaaataggccctcgaagtattataactgcatcgtttcagctaagcagacaattaatggctatgacgctcgaaaatcatttcacgtccacgaaccggactctattgacatttcatgatgtgtgccacgacactgctatggagtcggatatatacttcgagtataactggttaggcgcatcgatgaacattaccatactgaaccccggcctctatacgtttagatggtttttcccatttgaggttttcgtaatgccggtggtagttacgcctcccaagtccagagcggataccgtcacgatcgctcccgtaggactataaccctgttggacaaataaagtatacagactgttcaaactgtgtagtgagtccatcttagtcgtactggatgcaaacgagcccaataaagtgtaacagttgggaaaactttaactgtcgtgggataacccttataatgttatagtgcagtgactgacttgtaagcaaacattgactggaagttagcttatactgtacttcgtcgagactgccgttgccgactgtacgatggagcggcctctcgatcgtgactatcaaagtgcgataacgtgcttgacgtgcgagagagtacttttttgtcgcctctgacatgggcaggttcgtggcgataactccaactacatcaatgccaagaggtttaagcgttaggtcgccggtttaaatactcattcggaagccgtgggtggcgcctcgcgtaccccagaccgttgtgttataaaacccagactcgtcgccacacatgtaggcaaaaaaatgactagcgaaagagctcttgcgctagcacccggtcgggcggccacggcagatttctacgaagtggatccggtatatcggcgagacttcgcacgccggcttttacaacgtaagttccagcttgtcgtgttgtagaggtatttactactctgatcttcacctaattagcaccatgccgtttgtatttaggtttattccccaagacgcttgccgccgtcagggaatcggagggaggccgaaacacgcgcccgcccaaaacagatctgtgtacgcttttgcgcataatcgcgcatcatgagaccccgcacattttcaccccaggtcccagactcccgaaatcctcagcaattgtcgacgggctatgggtagcgtgtcgaggacttgcggcagagtgcatgttcgatggccgggcgacaatagagttagcagaacgcctcgcaacttcatggttgacggccataagattaattctagtttggcatcccgtgtatgccctcggccagcaacacgaaccactcgagcggatatgtcgccaaggtcgagaatatattgctatgctctcgggaacgattcaaacatcgtatgcgacatggccgttttggcaaatgatgcaacgatgcttagattggtgctgctcatttcacatccccgatgaccgttcttgtgagcacggatctccacgtctggggatccaactagagggcgaaaaccagatattcgcgccaagtttggggctctactccgctgtaatggcatggaccccaattccatgtcacgtacaggttcctgtatttccgagacctggcgaatcggacgatgtctcgaccccgcctagtggggcacagataggacgggtgcgacctcacagtcttcaaaggctggcactaaaacacagacctattgatgccgatgtacatagacccatgccgttaggccggccactcccttcaatgcatatggacgatccagacgatccgcaacctggaccctccggacaaggccgggcgcccagaactccaactctggaaggagtccgggtcgcagaacaaccggtaagtcttcgccgcgcaagaacaccaccgccgccgctcaatgtcgacgaagacgacaacgatcttcctcccggccaacccccccgccctcatcttcgaactcccccatcatcaccatcgtcctccgagactgaaatcgatgaggaacttaacgcgcaacccgatccttggggtacaaaccgtagctctacccctacagataactcctctgccagtgaggatgaagccagagggagcgggttgccccgaccattgcgcagcgcgactactgaaccgcgcgtaacgcgtagaagccgccgtgaggctcgcagccggagccgaagtcggtctggagaccggaggtggggaccgtcccgattaaggtcaatgcctggacgcaggagagcttctcgacaagatacagtacttgtagacagttctgaagaggaaccgtagccgtttgtagtcagggttctagttaagtaggcgccgcgcgatttacgaattagtacatttgggccctgccgcgcagcgagcgtctcacgactgcgatagtcatgcacgtttcgctggtatgggtgctgtgtttgcttttcggaactagtgggggtgttttaaagtggtctgacgttgacttgtcgcggggattcatttcggtcccaaatgtaagttcgcttatgcttttagactgcgctccaaattcgatactctcaactgccagattcgccgatctgacaacagatgatgtccctaccggtatatttattaagatcaattgcagcgttccggaattcattttatggtatgggtctaaaagcgtggcggcgcggctcaacccaattattgcaagcgctttaatgatggacgatgttttaaagagcggattggacgattccgtgaaggcggaacttcgcgtgtttttaaaaagaatatccgaacggctaccttggagctctctccggaaaagacacggttgtctgaacctggacgcaccttatgacttctcctgttatggctcggcacggctcgacagatttgaacgagacatcgaggacgatggccgcggaatgtcatgccgagctaaatcaacccgagctaaagcggcccgcaccaacgccatcgagggatagttcggccgcgattaaaaagcgtcgccggccgatcggacctccgcccggtttcgcgccactgggcgataatgcgccatccccacagggtgaaactgacgcgtacggacatcaactgtcgatgaccgaaaacgtccgcgctgaattgtggcctgttatagccgagtcttacaacatagactggagttggaaagattggctgctccccgaattatgctgtcctaacggctccaagttgttggcggaatacgaacgccgtgctgcggtagaagacgtctttcctccgcgagcagatattttcgcgtggactaagtactgcgctccgcccgacgtcaaagttgtgatcgtcgggcaagacccgtacgttcatccgggacaagctcacggcttggcatttagcgtcaagcgcggcattacaattcctcctagtctgcagaatatattttcggcagtcaaggcgtgctatccctcgatcgaactcggagcccacggatgtctagaagactgggctaaacgcggagtcctgttactaaattccgttttgacagtaaagaagggggagcccggatctcatcactctctaggatggcaaactctggtgcgaaacgtgcttcgaagactgtcgttgtcgactcgaggcatagtcttcatgttatggggagcgcgggcacagactatatattttcaaacggatcgcgacgatcgacatttggtgctgaaatacagtcacccgtctcctttatcccggagaccgtttgcgtcctgcacgcactttaaagacgccaacgagttcctctgtaaaagcggtaaagggggcatagactggagcattggcgcgtaagtgacggaagggttaatcatcacatgcgtacaaaagtcgcagcgctctaggacttgtcgctttctgcgcgcgcaatgaacgataccgcaccttctgttttggcagtattatccaactggggttggaagagcacacccttgggcaccgtaggccccgtcccgattcgcgacgagactgagtgcgcgcgcgaagaccttccggcacatgattgcgaccactggtgtaaaaccgccaatgcagaaaacggacctatggcaccctccccggggaatcgagattttgcgggaaaccaagaatacacacatttcgacactctgtttatggtctcgtctctcgacgaattgggaagacgtcaactgacagatactatacggagagatctaaggcattctctggccaagtttacaatagcttgtactaaaacctcctcgttttcttcctcgcacgccacgaaaaaggttcgcgcgaaaatgtttcaaagagggcgtcagagcaacaagagcttgcagatgtttattttatgccgcagggcacacgctaaacatatccgggcccaactgcaagcggtaattcaagctcgaaaaccccgcaagtattacacccgcgccgtggacggaactacgcatccggtggtgcccgtctttgtatacgagtttgccgccatagacgttgtcagtttgcatcgagacaacgtgatagaggtagacactcccggctcgtgagcttctcgccgctcatcatgttcgtcgtttcggcagctttagcatccgcatcagactacgccgcgtttttgcgggacaacaagcaagctgctcgcaagctgcagtttccgttgtccccgatgccgagccaacggatcccgcatctgtctaaggatggcaggactgcagtcgcccgggaaacggggtcgagcgaggttatgtcagcgagcggacagaacgcgtcgacccgaccggtcgacgctcgtttcgccaacctagacaccgagaaatgacaagaagcatctaaaacgcgcttgattgtcgagtggctgaataaaatctttattgatcgactcgctttcctatttctgatttaataaccatagatggggcggggaatctataaaataggcaaggtccgcgcggattcgagcacatcgaccgcgtccgcgacacagcatgcaagtggcgacgaacggtcctcaggcatgcacgactggtctatctgtatatctgcctcgcggatcgcttccgtgagaaggtcttcctcgtacccggttgagaaagcgtccactttcgagggtccgtacccgtgcacagcgccaatttcgtgcgcttcgatgcacttactaatctcgggcgcgttttcgggcagagatcttatcggatcgcagctctgtcgatgcgcatctttattagggtctgcgatcgcttggcaatacaatcgcgcgctggattcgtgaccgacccgcattgcattggctgtttgtgtcaaagagccgggcttaccgtagatggtgatcgttatgtacagtgacgttcccatccacataacggttaaaattcctccggaactgctgtataagtaggcatccggccccgtcacggtacacgtagcaaatggtatgacgcacagggattcgggcagaaaggagagcggcgcggcatggtattcggcgccgcactcgccgacgcgtagaagataagagcaaatgtccgcgccgctgtcgacaatgatcagggtacctaccggtcctcgctgtatgataaagttcgacgatgggatatgatcgcatctggtcatcttaccaacggcaatcgagcgcgtaccgcctgcacatgagcaaaccatctgctcataaggaggcattgtccacgcgggctgagcagtgacgttctcaagcgtatacgcgatgaacgtggaccccatcatatccacgtctcatgtgacggccctatgcttcatggccctagttagtatacaatgtggactttcggatcccggagggcggctaataagtgcgcgctgatattgttatcatccctagtatgcgtttcccgaagtgggttaatgttcatcctcagaaacttagaggaggtcactcgagacatggccacgtagacgctgctgagtttgatgcccgattgggcaaaacatatagcaaccctctcaaggctaagcccttgcgatctggcgatagtcatcgccagtttggagcttattccgtagtcggcggttacggccatccggagttcctgatcgtctaccgtttcgacaaaatcattgacgttggtgttaattgctgccatgaaaccgtgttgatctttcaaaaccagggtcggcatgtgaagttccccgagcgcttccgcgacctggggatgtatcttacgtctaataggctcgtctgcaaatgtgttaattctagcgtatgtgtaacccatgagagtgtagctgtccgtctgcaaagcgagcgatagcattcctccgcgcatgctatttataaatatttcgcaccctttaaagctcacgttgtcgacataactatcgaatctggacgctgcaaacttttgcccgaatagctccgtcaggatagaatacctgcccataaacatgctcttaagcatgctgaactgggtatatatctccgcagaagtttctgcgcgtccaaattcgtaattgcaataaagcatgtctatcatctggtcgtcgaaatccataaatagggcatcgtctgtatcctccacatgactgatttggtcattagctatacaatctaattccttctcactgccatagcggtgtcctggaatcgcgaacgactccctctgctccgctctatccggaggttgccgtcccggatagagcagcgcagaggtaagcatcgccaatctatcgtacgcgcttttaacagaattgtctggaagaccctgccgttgcagatagttgtagaactgtatcatgccgttgaaaagcagttgagataagaaacggtacacgtattctacagacccatctccgtgcgtctttatgaaggaatcgtctttcaatacggatagaaatgtctcgaacgtcccgcaaaagccgaaaacccacttccgaagtcgggtagtaacagccacttggctgtttaagacataggcaatatctacacacgataccgcgagcccctgttggctgcgaatttcacatttggcctgtgtggcatcttggtcgcgactttgcgaccagttgctcaagcgtcccgcattggcagcaagccatttttccaacgtaacgtgcggttggttggcagcagtacgatatcgttcgaaactatccaaactgacgaaggtataagccggcagggtaaacactacaaatttcgtatttccggacgttttcaggtagtcgtgtaatctgctcatgtacgcgctgacttctttatgggacgaatacagacgcgtccatcccggaaggttcgcgggattgttgatgtatgcttctgggacgacgaaactatctacgatccgagcgtgctcctcggttatgggaagaccatactctaaggtcttgaggaggtccccgaactcgggttcggtgcaccgtttgttattaatgaatatcgcccagttcttggacagttctaagtacgagcgcaacgtctggttgcatataatatacgtaagaatattttcgctcgtacgcacattacacttcagcttgctatgctcaaatgtggactccaaagaattcgtttgcgtgggcgacccgacgcatatcaataccggcctccttcttctacagtactgcggcgtgcggtaaacggcgtttgtgagccaccaactgtatacgatagccgtaagcaaatactttcccagaagtccagcctcgtctatgacgattatgttactgcgagtgaacgagggcatcgaaccatgtatgccgaagattgtccacgccatactaccgcgaggcttgcttagcagatcctctaacgcgcgaatcatttcaaaccgccctggcccgacctcgttagacaccgccttcaaggcgcattttgtaatgtcggataaaacgtcccaataatacactatatcctttttctgcaattctttcatcgtcggtgggctggtcggacatacgtactgatattttcccaaattcgcttgaatgtgattacctttaaacccgaattcctgaaatatcgtgtttatgtgctgcgatgtgtatgaattgctaagcttgcaataaatattctgcgctgcgacctttgtcgtgccggtgataatacagtccaagatttcggatagcatctgtatgcacgtgctttttcctgagcccgcatttccgcttattaagtaaacggcgaaaggtagctcgcggagttctagatccaacgggctttctagttttgacgcgttcataaaatacgatagcggggggactatatcatcgctcaccgatgcgtccgccaggctccttacacgcgcaatgatagtctgtatcccgtgcatcgcagtgaaatttagatacgttgcctcactgaagaaatcgttctcccgcgacatcgtcggtcttggggaagacgggagtgacgaatctacgtatcttttagggtcggggctggcgtgttgtttatttccgatggagagctcagacgttcgggccgcacgcagtcccgccctaaaacaaattcgacggccgcagttgcaatctgtcacgcgccaatggaaactttcaagcgacggcgattcgcaacagtccctggaacaggactggataataattcaccctactcgccaaacacgtatgttcaaagaggtcctcaccgggcaattgggatatacagatggacagggcatatataactcggtacgatctacagaagccgcgattcggcagattcaaagtaccattctcaccctttctttagatgcggtcagatatgacgacttgaaagaggattggtcgaagcatatggataggcgtgggatgtcggccaaggaaatcgcaaaaaagtatggcgttcatagtgaagccgaagctgttagaatggcaaagggggtgttttcaacttggcgtaaaactcttcaaatgaccttaatagaattggttcggcacgcaacagattgcttcgccgcggccgagaaaaccacgtcctgcttctctaaatacatagactggatctgctgtttaggtatcgttccggtcgtcagaagcgagcgctctatgcaggcgtcgcggccggatagcaactgcagagatcgcgctaccattcgcccgaattgggtattcagcgatgccaccgctaagctactagttgcggatagcgttatggcccgcgcacaacaaatcgcggattacttaactgcatccatgcaagcactgactgtgatagaatacgatagggcccagatagaatataatttcttaaaacgtgaacttcgcgttaaggacgtgttgagcggcgaacgtggcgagtgtatcgttatttggagaccggtaatgaacgacggaggggtaatttttgattcgcccatgcagagaatctacaaggagatgattgaatgtcacgatttgcggatgcatgcggcgctgtgtcggctagtaaacacggcccctataaaggtcctcatcgggaaacgcgatgaggatagtaaaagcatggccggggctcaaagagcaatcgataaagttctgggagaccaaactgaaacggcggcgagctctgccgcctctaggttggtcaagcttataattggcctcaaaggtatgcgtcatgtcggcgatatcacagatagagtgcgggattacttggaggaaaccggcggacatttattggatgcctcgcccgtggatacatctcagcctggcttcgggcgcgctaatcgaccacagagttctacgatatccgatggaacttgctccaataccgctagactacgtgatgcgttccacgcgtccgtcgtgacgagtataaacgaaatgttagagggctatataaataaacttttccataccgtggaagggttaaaggcggccaataaagacttatctgcaaaattaagctctaaagaaatagagctcgacagaatacgcacggaagccctgatctcagaacgggcgcgagctgacgcctcgtgcgatcctcactgcaatccaaccatggaaactttggtgcgcgagctaaaacatgacgtaattgacgtaaccaatgcaatggaggatgagtcctatatcgcgaatagcttccagtctcaatacataccatcatacgatggcgatttgaaacggctctctaacatttgggaacaggaaatgttgaggtgctttaagatgactcgtatcaccagtaatcaaggtcgagaggtttcgatctcctactcaaatagcgctataactttattactcgccccctatttcttctccgtgttgcagatctatgatattggtgcgatggtcacgagccaagacgtttacaagtcggaggaggagttatgtaattccgtgcttgaaaaaacccgactttgtacatatctggatgatttggctctcgtctttgaggccgatgtgaaaagagctgtcgcgaagtattcgctccgtgcgggtaacgccgaaatagacttagcgcccgaggagttttcgtacggctctcatggaagcaaatgcgagacacggttttcatccgctagacacgagcgacacgttggacgctctagttttaagcacgctaaatggagaagtcggccaaaacgagaccgtagaagaactaatttggcaaccgacggcgcggatgatgatggagatccgagagattcaaggcggtcctactcaattcacgggcgtctccgtgagtaaacttcgcgtggcaagatgtgatacgcgctttcatctgactttaaccggagccgacttggatgatgaaatggcaagtgacgtataccacagtcagtgcatagttaattcggcgttcaaaggtttcgtctttatggttctcacggttacggaagatatagtgcggacgataggggttccaccccctctgctaaaatacaggctcgtgttctataacccatctgaacatttggacttcgcattatgtttgctcgtagcctatttggagaatctccatgcaagcgcctgcgacgtaacttttttcgtacaggttcaatcttttctgagatacgcatggacacgggtgacgccaatgaccaaaatgcgcagatttttatgcgccacgaacgtttggttactaaacactttgatgtcgatggggtcctgtagcccattcgacggagatcgagtactcccccattatgcgatatacagacatttgtgttctaccagtggcgtctgcgacgtgttactaaccttgtttgaacccgatacacggcaggtacgtgaccgcacgcacggcaagggacttgtcatgctcaacagaggaattatgaataaggcttttcggcagacatggattagtgatacggtctacgattggtggaccggcgaacgcgagaagttgatcggagaagaatctctgttcaacacgtataatatatgaataaagtatgacaggcactgctataaatagaccgtggtttcttagcgttttcatttatttattgcggacgaacagaaacctgtacggctctacgtcgaatgtgaatttgctgagatcgacgttaggccatttcgatgttagagcaccgatcagtaatctcgaaaaaatggacattattggtttcatatgatcgatgcacgcgatggcagggagaattacttgtcccccttcgaaaagtgaacacgtgagaggtgctatgctgccgtccacagtcacggtgtggacggcgtcgttactgaaggcgctcgtatcgaatctagctgccgcccgtagtcccaaagccgtgatatagtgagtgtggtcgcgcgattctgcgggacagctccaaaagcaggcgtctccgcgggcttcgaaagccgcggtcacgagctcttcgaacactgcacgcgatcgttcttggattgtccgtagggactcgtcggaatcgttgcatgcggaaatttcttctaaaagggcagacaaggctttcttaacttggcccgcaaacgcaggtcgggccggaaaccccacgaaatctgtttcccgcttagtttcgttccacagccagtaacaattggcattccacgatactgcatgagtgtataccccttccattcgaaactctaatctgatatcttcgggaaaccgtagcccgactgacgtggctaatttgttagcgctcttaccgcaagcgactcgtagtgtttctaaagcggtttctgttcctttagaggaatgcagaacgttgttggccccgtccgtgaatgtcccccacagtccatctttgacgtaggtacacggggcgaatccgagagccgacgcggtagcttctacctcgagactaatatgattcccgatacagataatagctctataaacatcttcacgcactcttttcaataggcctccgaactctatgatgggctgcttcaaccagtttttctcgcgctgcagtcgagcttttaccgcggcgcgcaaccgggaatgatcgggaaacagtcctagatatagagtcgcaaaaaaggcgctaaaatcaaactttgcgatatacgcttgctctatgaaagtcggttcccggaaaatacaagttatccgcccagccgtccagtcgtcggctacctgacgccgcgtactgcttgtgcgcccttttaaattttcgagtacgtctataccaggggtcggatgggtttccggatgccaaggagcaagcaggtggaaggttctcggtccggccagtggccacaggccatcggtctccgaatagctgccgacggcctttctgatggccgagggggccgccgtagatgttttcaagagcggccaaaggggaaatccgatagtgcaggcatagtcaacgtcctcgccgcgcggactggtttcggggccaatatatacaaatataggggccagccttttttccgagtcatcggctagagagtatatttttttgtgccactgcgcatagatggccaataatgccgtgagagaaaattcggcgggtgtcgtaaccaagcagtcaaaagacgtcggaaccggagccgcggtttttatgggtgcctgtgagtcgggtaatgatagaacgcgttcgacgatagtgaatattctattcgtatttccccatttgattttcttggacctgcgacccactgttttatattcgcggatgaaccggtcttcctttgtgtaaatttcgatacgggagtcgaattccgggatcgtgtcgtcgtgtttaagagccgacaatttaatgtgggctaggtgcgcgccctcagtatactccatagccgtggatacgaggcgtgattcttctacgtgcacggcaccgtccgtttttagtagccccggacggggagcacatcgatcgcccggcagaggttcgcacgatataactaatcccgttgttgtgtctacgtacatatcgacgggtgcgaagtatgcatgataaccgagcttaattctcaattttgccagcgtcacggcgagcagcgctttccatagagcgtgctggtccggcctgcaagacggccaaactcccgtcacagatccggcactggccataatcgccagtgccgcgtcggttactgaatccggattcaatccccaagctctcgcgatagaccgtcccgatacgtttaccgtagagtaatgtgcagaatacgtaccgcactcatttctaaaaagcaagtaacacagtgcggtaagaccatcggtgcggtctctactagtccatactctatacaaagtggtatagcaaatacacccccggattttctgtaccgccacagtattagcctcagccattgttgacataactaggttcgctgcgtacgccttacaaactgtgaaaatctatagcgccctctacacgaggccagcacgccgggggaacttctgccaaaaccgtctccaggtccaaaatgtcgtggtatatgcccaattccgcgtccaagcgagatttcactagcgcgtaccacttagggcgtcgaatctcgtagcgcgttttgcggaacgacgctttgtttttcataaggagtgtgtaaagcgcgcggtgcgttttgatcgacgttctatctatccccgccccatccaacaaagcttctatctccgcctttcggagattcttaactttggtgccacccggaaacgtcgtcgcgctctttacaaggcgtaacccatacagtatttcccatgtgactttaaaaacagaaaaggcgtggttctcctccgtctgccggcccaagggatacctcgcgagaccacttaacgcgcttttcgttgttttgactgatcgtttagaggcagtacgggcatccagcagataacatcgcgtgacttccaataccgaacgaataaaagtatcgtactcattttgcatcacacgcagcatcgataatggatctaaatttttagctgttccctctaaagggttaatacccaacgaggtcgcccatctgcagcataaccgatataagtgccaccttccagacacgttgaaatcggccgttattgcgacggtacccagccctccatcgggcccgattattggtaagctgcctgatgcgtaatactgataaatacgacagaacacctcttcactataaagagcggccggcgttgcgcgacacgcttccaacatcgtaatatttataaattgttctctagtaagcggttctgccagtttagttaataattgcgcaagatcgctcggcgatccgtcatgtcttagatatttatgaataaacggctccaccatctcattgtcgatcagatcagcctggatttgaccgcaggcaattttacggaggtgtttcaaatctcgttgagcgataagggcgtctgccgttaaatccgctaagaaggcgcagaaggtttcagcgtccaattgagagtcagatccgtcaaatctgacgcttattagattcgcgtcaagtaaggcgtggagaatattgatgctgtcgctaagattgttgagggtgcaccgttcaaacaaatgcttgtacttaaatcgtgggaaaatgtataacgcgtcggcggacttgaaagtcggaacgcaatctcttctgaaattgttacacaacatattggtcgcgcatacgaattgcgccggccatcctcccccactggcgatgacgtggtttagtagcatgggtgtgaaaactggctccgaacgagctcccgatgcatctatgtaaaccaagacttcgttacggcgtaacgatcggattctacctaaagattgatagaccgaaaccatatcgggcccgtttcgcgtcggcttaatatacgcgaacatgctgtggaagtgggagctgataaaacttaggcctactgttactacggtagtgtagatgacaactcggtaacgagtccatgaatttatatcaattggtatatcacgggtggaatttaagaccaggacagaatcggtaaatatgaggcagaagcgtgccgccgcttccgagaatgaaattgtcgaggaaaataagcaaatgttcaacccgcccgcgagtcttctgctgagttcagaaaaaaacgtcgtctcagtcacgcttctatgccgagagtgggtaccgtcagccccgtgtttaggtgtgggtcgtacatgaaaacaatctgattggtcgctattcatgacggagagaagtgtatctgttcccagattgcggaggatggtacatgatctcttagaaaacccaggggctgcgtattcgcccacgatgacatgtatgttatcttctcctctcatgcttgccaacatatctaccagttgtgtatttattgtagcgtccattgctatgatcctcgggcaattacgtaacagagtcgttagtatcgaatcgactctggacagatgcctcatggttggagagtaaagttgactaatggtcgacatgacttcgtccagtatgatgatttcataccgtccgagcaagtcagggtctatgcgatgcaaagattcgatttggatcaacagtctgtaaaactctctgcctcgtatgctgtagtcactagccgtcaaatagttgccgaaccccgacagcccggcattgctcagtttgtcgaataatgtgttcgtaaaacttcgcctacaggacacaaccaaaacgctcgtgtccggattatataaaatacgctgcaaccagtctatgagagcagttgtcttgccggatcccataggcgcgcgcactacaagtacattgcgcgctctcgaggacagtggcggcggaaaagtaacgggcccgtcggattggcgctcggtcgttactccgggtctgttcttagctatccaatctatgagaccttctccgtataatatcctcgacaaagaggcgctacagacatagtctatcattttctgtgcggtcgatgctctaacgtcgccgagaccggtgctccgggtgaggattacgttctgacgaccagagaaccgtctacgatcgtcgctatgtcaaaaggaccgcgatcggaaggagcccggagaggagcagatcatatagactacattcacaaaaagatgtgggttgtccaggcggcgtgtttttctgtcgccgtcttggttttcctaggaaccctgatagctgcatctataaacatgaccgaaggtttcccatgcttttttgcggccgtcgtggactacgggatgacgaacgtgacgcttgtgcatacgggcatgaccaatccgaggctgggaggcgtagttcctgtgctgtttttccaaaccaaagccgtggcgtttctcttctattcggcgagcgtcgtttttgtatgcatcacgtgttatatcgccgtaggcgccatcataactagcaagaaacgagtgggtgctgcgtataccggaaggggcgcgttcgtcctttcacttatggcatcgccctcgacaattttgttgggtactgtgtcgatttggcttcttcaagcggtagttatagtcctagcccacaaacttattgtactagccgcggcggtttatttagtgcacttctcgactataacgtttttttatgggtatttctgtggaaggggcgttgacagtaaagtatatgcggaagacatcgctgctgcgaaaaacgtagacgccggtctgcacagattaattggaaacgggcgggcggtcatgatcaacttggtttcgatcgtatacagtatgcttctgataatggcgtctctaatgttaggcatgttactagcaaacagctttaccttaaagttttggcatgtcatcgttaccgtcctcataacttcctcagtcttaaccctaatgtatcttttagtactcgagttcctagtggcgcggtacgtgcacatgattttgggtgcgtacataggccttctgatcgcctatgggatgctctggaccacctcatgtgattatgtcaaccggttctacttcgcgatgggcgtaggagccggcaacttacgcactgcctgtcacagcgtgctggcgtttttcaccgtactgattgtagcgggcatgattgttcgcctaatccgggccgggttgtatcaccgtaggcgatctactcgtgcatacgccaaagccaggcagttacaaagaaatgtaaaggagagattgagacgaatgagtcggggacgcgatcgtcccgatagccgagctgaggacgagcgggcgcttacgcaaacccaatatagcgaaacatcagacgacgagactatatatgatcgcgtttattcggggtctgatagtgaatgggatgaataggaacgcccgaaacataataaaacgctaaatctacaagtgattgtcgcgcgacttatttatcactataacgtatcgttacattgttcccgaccgtccttaaatctgaaaagcgtctttcctctcgcgcaagtacttccagctaagacagtatcggaatggataagagggtcggaggacctaagaccgtccaaatcgacggtatcgtattgctcgtcgtcgagctcaattacatgtcccgttttggtcagaacggtgtttcgtttccgacagcgtcggaacagttccgttacggatattgcttggcccatacttgctgcacgagttcaccgaacgcacggtatccggcctcttctacttcaccgtagaatgtaacgtccacgaccacgggagtgatgaggaggagaacgggaatcgcttgttcggggtctattttgacgcttggagtgggttctccagtgtttccttcggagatcgtcaggcgtctacctaattcgccaggtcgtctgcggcggcctataaacgtggcgaggtgtgggatgaccgggttgctttcaaagtaattagaagctacgtagttctgaacgaaaatctgcttgaaatttggatgtcgtgggttggcaaatatgggcacaaggacagattgttctccggtactccagcatagcgggtgtatcgcgttcgtttgcagatcaggttcgccaaacagccatacgcgagaactgcagttcttattggaggccaagtgacgcgaatcaaagtcgttccgtttaatgtttgatgaaatggcgcggaagcgtgatagccccactttccagtcgtcgtcacatgtgattagcgcctcctttgccttaggaaaatcgtcaggtttaaaatagtccacgcaaggatgattgatggcgtataagaatcttcggagcgctgcgacggttcttgtttgtaataggcgttcgtaacattgagatagctcgcttcgacattccgggtaaaacgcgtatttggccctacactttatttcgtacgtttctatggagtggtcggggagggcaggcgtaaggattccgcgtgcgctgcgagggcataccgccatatcgagggatgctccgagcatcccggttctggcgtctatcatcagaccgcacgcgtatttgtcagaggcggatgagacggtgattgtctcgtccggtacgcgtgcattttcgagcacccgagaaggttcgcgaggcctgtacctggggttctccagacaataggtctctatgagcgctctcgcgagcggctcgttacgcgttccgaagactacgctttcgggcattccttgcgccgtgatttcggcaggtcttatgccaacggtgtttatccgtccatcggcggtccacttcaatgtcgatgcggtcaacagccattgtctaagtacgtgccatagctcgcagtccgcttgcggtctggtgagagtttctacaattttacaccagaaaagcgcatgattagacggcgacgttgcatttgcgcccgattcatacaggagcttgtcttccgcctctaggagagaagaatatgaagatgccggccaacgtccctctgaaatgcctcgtttgataacgtccgttatgtacaataagcggtgatacagcgggtgtggcgagggccccgattgcttcgggtcgacattccgtaatatatagtcgctgaaggtataatcgaccacaacactgtagcatacggtatcgtaaggtttggactgcactgcttctgcgtgctcggcgcaagcgaagacctttggacacgatttaaattcggactcctttttacgtttccgtggcccgttctcgccgagacggaacattgcggtggagtctatttccataacagccgtgtagcggccctcgcttctgagttcgagtgacagtaaagtgcaacgagctcgaaaagattgcttaaatatggcgggactctcaatgaatcaaatagcttcctgtgcgtcacttcatatccttctaaatatttctcaaacgcgaccctgtggtgagagccgtgtagctgcgaacgaatcttttcggctcgttcccacgggataccgattttggcagttaacggggtagctggaaataagtactggtacagcatacaccgatacgctaacatgtctaaaagatagtcggccggcatcattttatggtaataaaaatgcaccgggtttccggggatggcaaagtcccgcgtaaaattcatcccggcggctagaagcacttccatcagtgattggcccagtgcgtacatatctatagcgacaccttcatcactggacagttgacttgaaccccgctccaagcccgtcccgtttaaggctttaaccagcaattcgcagggctgcgtttgcccatgccccagcactaaatcaaatacaggtctaatgtttgctctagacacttttactgaatatactcgatcggagtctacagttatgtcgaatcgggctttcgtaatggtggagtttgtgttaagtaacgccaagctaaaatcgccgattacggcctccactataatagggttagacccttccctgacgttgacgaaaatgttcccgcacttaatatccaaatgagtcagtccgcaggacacgttcaagtacacaacggctctgccgaggcccatgaacgctttttctatggccctccaatggcgtgcagttttatccatcttcctcagtcgatggcagtacgagtccatgtccatgtcatacgctggaaataccagttccctggatggtatcgaaaaggccagtaatgaaatcacgctattgagcgctagagttgaccttgcccgacaagcgcattcgccggctatcagtgtcataagcaattcggtcttgaaacactcgaacacctttttgacggctacatttgcacccttaaatactttaacttctccatagctcccgcttcccgcatatattggcgtttcttgcaggtcgatggtgctgtaatgtaagcccggggagatatcgaaaatgagcgatgttatattctttatgcgagatagagtgaaaatatgatccggcaaagatggtcttgatagcaaaatgtcagatgttttcctagatatatgtttgcgtctcctatagaattgttttaggcatctcctaatgttgacggagatgtgttgtttgtggtccttttttctacacgaatctcttcggggggcactgaatgttccctgcagatcgtctgttgtgcttgagtatcccttaggcccgctgaagtcttcttggtcgctgatgtcggaaagccatttaacgtgaggacactcgtcgttttcgcggccgcgccccggctttctggctttgaggtcaagatccattttgacagcagcgcctcgcactctgcgtccaattctatgtctggaaggcgatcgctgatgtcgtcgctgatttgcgttaagatgtcttcgtttgctagaatgtcctcttcggcacgatccaactgtgactggagcctagggtttaaaaaccttcggttcgcatctaagacgatgcggcggtccacctgttcgtctatgtggcgttggataattctcgactttctatgagcttcttcgatccgcatgttcgagtgcaactgggttttgtagtcactgtgggcgtttctggctgacgttaacgcttcgatgagttctgggtcgtccgcttctacaccttgggacaaaagtgtcaaggtgcgttccttataaattttctcccgcgttcgacactcggccaatatttgacgcctgcgtctgcgtattgtgttaacggcgaacatcgctcgacgagattcgtagtctggcgattaccgactccgtaaagatgttcggaggcgcgctcggagaatcggcgaagaagcactttgaacgcctgctgagagataggaacgagcgtttaggtgcgagccgtaaaaatgaatgcctcgcgcgcggcgggagtttagtcgacgccccctttctaaattttgcgatttcggtcccaaggcgacatcagacagtgatgcccgctgtcggtacattgcatgactgctgcgacggtactggtatttactccgcgatcgctacacgcctgctgtatgctggtatcgtaagcagcgaatttggtgaagtgcgacgcgagtcgttatctaacggtcacatatcgaaaaggaatcgggaggcgttgcttgcgccgactctgacacgcgtcgccaattccataacatttcacgagtacgacgatgcacaatgcgcggcgcatcgcaacgcgtattacagtacgatgaacactttcgggtctatgaggacatctgacgcgtttcaacagctggcgtcctttatcgatcgattttcaaaattattagctgcctcgtttaaagacgtgaatattttggacagaaataacgctcccaaacgagcacgaataaccgctccctcgtacgataagcctcatggcacgctggagctgtttcagaaaatgatactgatgcacgccacttatttcttaacgtccgttttacttgaagaccacgcggaacgtgctgaacgtttgctccgtgtcatatttgatatcccagacttttcggacgcggccactagacatttccgacaaagggcgactgtttttctagttcctaggagacatgggaaaacttggtttttggtgcccttgatagcactggccatgtcgtcttttgaaggtatccgtattggatacacgtcacatattcggaaagcgatagaacccgtttttgaagaaattggggatcgtctcagacgctggtttggtactcagtgtgtggatcacgttaaaggagaaaccataacgttttcgtttcctagcggatcgagaagtacggtaacgtttgcctccagccataatacaaacgtgagtattgcattcaaaaccgttgtgtcggatggtcccccccctatacacacacccgtgatagtctaatacacccttgaaccagtatcgaactccacatctccggcaggtagaccaaatgccatccgcatgaatttacgggaatcttcctactgtctacctcggcttcgattaactcttcgagccgttctgtaatgcacgccttcgtgccgctattaccgaccactcggacggcatttaccgtgtccatgaataaaacgcaacagaggcttttttcccctttgacttgtatatctgtctgtcgggctttcatccacatacacggacctctgcaaacacaagcctgcccgagcgatccgcactcccatctcacgttacaaacatccacgtgaaggtcgaaatgcccacggcattccgcacagccgctccggtggttaagaaattttgctagagtagcgcccagagaacgttgctgccaaccggcgggacatatagatagcaaactctcttccatcctgaggtaataaaacctgcgtttggaaagggaccaccaagctccaatagatatcgctatacagttgtgtggatcgtctggcggctgcgtgcgttggactagggaatttatgtccggtgcgatacaagagatagttgacaaaggttctatggcgacgtccggaagaccgatacaggtcctactaggagcgacgtcagaaaagaaaataagatctgcggaagatccgtcgcgcagaatgggggttatgcgtaaagcggcagtcacggaataggcgcgcgtcccgttgactaagaacaagagttgaaaagtgtttctgtccaagtacatctcctttggtcgcgtaaggtacatgaatatctccacccatttcgtcttttgcggccgagcgcccagcggtacgtacgtacataacgtaaagtctaacgtggttaatgcgaccaacacagctagacgcgattcggcccgaagcgtgcgccatacgcaaatgcggtcatttaacttattaacgaactcaactgccgccgtatcgcaagtccgttctgaacgacgcggcgatccgggcgtccttcgtcttcgcgtagtcatcgtcccacatctgtatgacgctaccgctaattgaatattcgagtcttggcagggcgctcatggaaaagataatgtagtgttgctgctgcagaggcgcgataaaaccgcgtccgcccgcgccagaggccaattgaactcggcgccggcatgcgctgctaacatgaaccccgcgggcaacacgattgcaacgcgcatacgttcatcataacctacgcaaatatacgcataactttctccaggaagaaatctttcacacgttgcgcgcgatacgaaccattcggggaatgcgcaggttctaatagattcgtcgcccggcccgccgggcgacaaatgcgctgcgtcacgcaaaataactgggataggcctcttatttaacatcatacattctccgcccgcgctataataatcaaataggaaaagattcggcgtcctagtagcgacgggttggtagtcgcctcccaggacttcggcattgtttccagtcgtatgtatgtaatatgtttttcctccagtgcgcttaacatgcctggccagaaacgagatgctcgcggacctaagagcgcctactgaaaacttctcaggcgaagaactcgcgattgcctgtagaactgcgcgtactgaatggggtgtgcggcttgcgatttctgccacgcactgaacgtctcgcgcatacacgtcgtagctgatcagctgatatagattgggccctgttttcaacgcttccccaactgcccttatgacacacgcagagacatacgacttgaaattaatcattaattcggtttcggagcccggagaaaacgcacgcagttggttttcctctgcttttaataagggagcagccaaaataggagcttccgttgcgatttcggtctttcttctttgtggtagacgagaggggtgatcgacgccttcttccatacaagcggtagcgagtaaattgctcaacgaagatggaattgtggcagaatcggaggaacggccccctaaggcaatcgaccgctcatacgatataagataaagtgtttttttggtcatggagtgggtacgtggaacgatggatatgcccccgcacctccaccggttcgcaattgtgagcccgtccgccaaaatgccgaccgcagaagataggaggtctttggggcttaacgaattttgcgatggttcatcgaacatgagaatgtcttccaaattcaatgcagtccctgtagattgctggtccttattacggccctccaagcccctccgagtgtcgtggtttctggcaaaccttcctttgcccacgggctcgagaccatctatgacggctttctgtgacacgctgctactgggtgtgcacaaattattttccaaacaagctatcgccccttggcgcaatccggacactacgctggcgtgtatattctccgccggccgttttgcgcttaccggcgctcgcctggtgatagcctcggctgccttcttaatgagatttgcgatctctatattgtctgtctctagtcgcgtgtcgagagtaggagtgtcgaagacgttcggagaatctgttacttgccgcataatgtcaaactgaccgggcagttcgacggcggataaacacgcctctaatttagcccccaattctataacagccgacggtaattcgacctcgtatctcttagtatatcgtatgaattgacggaagagcgtctttaagcggttcgcatcgatatcgtatcgagtacctggaggaactaattcctcttgactaaacagtaaatccatgtacgcttcgtactctccggtttccctatcctgtacgttaaagcgaatagccacggatgtaaacggatcaaagcggttcttagaatcatattgtatgggaagactcatgaacaatccaccttgatcgtttcgattgagcgtcgcgaaaagtttggcgtggcccgggacatgaggtatcaagagtatgtgtagtgcgccagagggaacgtaggctgccggtgattcgcgccaaccggaacatttaccggtggcattatagcgcatctgaacacttaccggaatcggcagcgattggtaagcactgctgggtactctctgtgccgcatccttaaaacgggcgatatctatccccgctgccgacaaacactcatccggtaagaggacatgcgtcagtacgtgccgattggggccgtgtttgggagtagatagcgaatacgcggtctcgctctctatatgcgcctccatcctgcaccggaatggcgagtcgggtcctgcggtctagatagcgtcgcgtcgccgttaatgcgaggggctatgcctttacggaccctctcgactcagcattgcttgtttttgtttctgcagagcattcgcggccaagatttcaacttgctctttgtcgacgaggcgaatttcatacgtccggatgccgtgcagacaataatagggtttctgaatcaagcgaattgcaaaataattttcgtgtcgtctacgaacagcggtaaggcgagcacgagtttcttatacggtctgaagggatcggccgacgatctcctaaacgtggtgacgtatatatgcgacgaacacatgaaacatgtgacgaattatactaacgctacgtcatgttcgtgctatgttctgaacaagcccgtgttcattacgatggatggggccatgcgtcgcacggctgaaatgtttctccccgactcttttatgaaggaaataatagggggtatcaccatggatagaaacacgtgccagggagaccggggggtttttactgcttctgctgttgagcggcttcttctatataggccgtcgactgtacggaatcaggatatcctctcgcgagacttatacgtgtatgtcgatccggcgtttactgccaacaccagagcctccggaacggggatagccgtaatcggtaggtatggagcagattacatcattttcggccttgagcactttttcttgcgggccctgacgggagagtccgcggatgccataggagagtgtgccgcgcagtgtatcgcgcaaatctgcgcgatacactgcgagcgtttcggaacgataagagtggccgtggaagggaatagcaaccaagattcagcggtagcaatagctactagaatttcgatcgacctggcctcgtacgtgcagtccggagtggcaccggcgccacacgacgtttgtttttaccacagcaagcctgccggcagcaacgtcgaatatccctttttcctcttacagcgccagaaaactgcggcgtttgatttttttatcgcccgcttcaactcgggtcgagtactagcttctcaagatttggtttctaccacgattagcctgtccaccgatccggtcgagtatttgaccaaacaattgacgaacctctcggaggtggtcaccggcgcgacaggcacaagaacgttctctggcaaaaaagggggctacgacgataccgttgtggccttggtaatggcggtatatatatctgcccacgcgtcggacgcgacgttcgctcctataagaggagtcgaggccacgtgtcgcggcccaacagaagcgtgaccggccccgaagcgtgaaatatatctgccgcgtcgcaggaaaagctaaccaataagcagactcgcataagcacaaaccgtttattagaaggctacccgatgaataaagttattttaattccagttagaaataacgggacataggtctccgacttttatactcgcgggcccgtcgaacgtgcacactttcaatagcgggcgcagcgctagcatgtcccctagatgcagagccatggtaatccacgaagacagggcttcgtaaatgggatatctgcgccacgcgtcttgcaaaggcgggggtctcggaattctgatgagctgacctactgctctcgtggccgtctggagacccaccagggcgttgacgtaaccgtcagacgctcccaaagtaagcaacgtcggtatcagagcatataggagcatgttaccttcgtcgatagcgaaaatcatgtttagcaataaggttctcactgcagactccgacgcatccagactatggagcgtcggactaatggtataggttttcccgttatatgtaatggattccgcttcacggctcgtagggggaggcgctagccctccgccgatcgctatcccttccgtggctcgagatagcgtcttagcaataatttcacgtgcgagtctcgccggaacggttgatggaaataaaagttcggtatcgatcgattccaaccggatacgggagcaaacgttagggaaaagcggaggtatcaggcatacagcatccccgttacataggtcgaacgggccggtgttttgaagtgccaggcctgaaggaatggtccccattcccaaaactacagcactcattcgaccgggtagcgcgcgggtgacgacggccgcaaatcgtcgtttgtaggtcgatagcagactcagcgtatcaggttcggccccagcgatgtagtatgacttataatctacttctttgagcagcactctggctctgacggacggtaaaaaaagaactcgcccctcacatcgttgaagtaggttcgcgtcgcacgtagaaagcccgcaggggagctcgatctctactgtcgtaccattagaagcggccataacggtaccgctggcggtttattttcggtaccgacggcggcagcggataagtgtataggaaccaggccgagccgctgtcaggtcaagcacgtagaccgcggaaggttagcgatcggcgagctggcagttcagcatgcaggcaagcatccaccgatcggcgaagcgtctttgattaagtattgagccaagtgcgtttctgggttatccgcaccccctgcgaaatacgtgcggagcaaagctttgtcggtagcgcaaagtagcggataggcttcctgaaatagggaacaaggatcttcgattaattccgtagatccgactggtcgtttgaactgtacttctccgtccgacgcgaatgctgccacggcagaaccggcttcgctgattagtttatccaagcaccggcttttgcagcacacttctgccggggtaaaaaatttataggtgggactgaagaggggagacgccccgctcaaattgtaagttccgttatagagcttgtccgcgtaagagaatttttgcgaagcccacggattgttggttgcgcggaacggataagcgggatccccctgccggtgatcgtacatgagtttctcgatatcggatacttcctcgtccgaatgtatcgccccggccgccctccctctcgggttacacggggttcgaaagtactccaggtctgcggaaacgggtgtagggatgaactcgcatatggacatttggccatgttccagcccgtcggggagcatgggcatcagtgtacctagaaaggggacagttctttgcggagctgttctctgtccgcgcgttgctgctttccgtagaaagtcatcggcttcggggtttataagggggggcgagccccgtgtcaaatgcaggctttggacagtgttccccatatccgtcgtagcgtttcgtaagagtaaaggggtacaagtggccgtataccccacgcccaaatcaacgttagctcgtggttgtgtcagagaaaactgcaccccccctgcgtgcgggcgcttcgagacagacacctgtccgagaaaaaacgattcggacgcccgttcggcaaacaggcccatatctgctaggaacctatcttgtcgtacgacggtaaatgcaattcccggatggaaccccgttctcaactgatgatacaggcctataggagtgagtttgaaatatcctgccatcagcgcgtacgacatttcgttgggcccgcatctactttcgcatatgtactgtgccacgggctggcggaacgtagaataataattggcgcccaaaaactgtggaacgggaggagctctgccgagcagcgtacgcgcgttcccggccaactccccgactgccgttagatggtcctgacaggcgaacaaagcgttaactggaacgggatagaagtacgtgccggcagcgatcgtctcatcattgcatgggtaggccatcattaaaagcccatggtgtaacgcgccatcgaacgttcgcatatgccttgtcgccgatgacgtgccgcctacatccggggtggttccgtagagaatcgccgttgtccgctccgccatattgttcaccgtttcctgcagagttagaagcgcgtccgcatccaccaatattctggcgttgtgtagcagcacgttaaacgtgttggggacaagatttctagcgttcaacgggtgcctcgggtcttctgcgcccaggggaggctcctcgtcgggttggatgtcgggaatgatcacagattgagacgtagcgtagatgttgtcgaaacggatgcccatggtgcaacactgacccctggaaaatgccgggaccatcacgtaataataaattttcgataggattgaccattcatgggtatgatgaggcgcgaacgtttgtcgatcggcgtctcctacaggcctgttatggactaaaacgttgccggtgcgttcaaaatccgcatcctgcaattccagccacggccgcacagcgtaattttcgtcgcttcccacgttcaaatacaagtttctatcgcgcacgccgtgcgcttgatacatcagggggtcacagtcccacagtagggggggtaggatcgctctatcgattaaggcgtggtttaattcctcattactctgcccggtcagtgagtctgtctgaacggtataatcctttacaatcgaccgcagcgcgcgaacgtgccgcatcagctctttgtagatattcgtacagtcctcagggagttcaccgctgcataaataggtatcgatgaatgcgaccatgtgaaagttattgacgaatgctactcgtttgcagttgtcccagtaactccgtatacattgaatgatcagtcgcatcagtataccgaaattacgttcgctgccgtgaattacggcttcgattacataaaacgcagtggggtagctaacgtctgagaacgttgcacatacggcattgattgtggaagcgctcattttgtggcgactggatgcgagctcttggccgagcgcatctctaaagtcgctactgcagagaggtagcggaatattacagttgcaaacccgccaggaggcggcgatcgacgccatcacttgcggaacgttatgcggccccgggagctctacatctcccgggaccacaaaaaagtcaaacgcgggatgcaactccatagatagatgtggatttccggccgataggaattgctcttgactcatatggcattcatctacccaccggggcgacccgcagagcacgtctccgatgttctcgaaaaaccgacggctagcttcccgtagaggcaaggccggcgggttcgtcacatacgccccgaaaacacacgttaaatcgcgtctgtcgcgacgtaaatgactaaccgtcgcttcgatatccaaaaaggatgagtggcacacggttccaatagcatccgataaacatacgctaattatctggttgtctttgttatggaaatatagctcccgtggcgggaacccgcgcacatctccttgacatccaggcccgggcgcatagtccccaatatgccgcgcataacggtccgcccgtttctgatatagtcccaaaggcatcacgaacgttaaatctatgtgtccgattaaagggtactggacttgcgttgcttgataaacgcgccgttccatggcttctagaaaaattaacttatccccaatggtcaccaattccgcaggcacttctgccgtttgggggacatcgtcgtctccccgtacgacttcatctgtacgatcgatgatgtcgttttcgtcgagattgagaatatagcgtgcgatgtcgtccatgttgcgtatggctttgcccatcactacggcggttactaggtttgttcccgatattatcatttctccatatgtaacgggcaccctagcagacgtatccgccatgtctagaattcctgatagcagtttttgcctcaccatgctcgttgttactagtacgccatctacgaggcgccctttcgaatcggaatgggtcagcctcggcattgcaattgtctgatgagtagagttaaccatcttggcgaggaatgagactatactgtctttgctcgcaccggctttgctcatgatgaaggtatcgttacacactctgcgtttgagctctgataccaaattcgctcgcattacctgcccgtttacccttccttctgtcgtgctgcgcgaaaggggtatcagtagcggagtcggcggagccttttccatcagtattctaagcatctgatcgaccgtgccccgctcaaacgaatccaatatcgttctcacgtttcgagctaattgctgtatggctctcagtctcaggtggttagatattgccgttccatctaaagatacttcagataataatgcgagtgcttccgccgcaacgacaaaggccgcgcttaacgatcgcttgcatacgcgctttaccatgtaagtgtaaagcggttgatcggcaggatggggcccctcgcgcgcaatcatgggttgctgtatttcaaattgcacggttccttcgcgcatgtatagcagatcgggagcacgcgtgcagacgcatgcgactgagagccccgtttcgagaaatctgatcaaagacaatgtattgcagtaggttccgagaagaatatcgaactgggccgaatagcgtccgttgtcatcggaactgaattgtttgaaatagtcgaacatgcatcgatgggatgtcatttctatagcagtcaggagtctacctgtaggcgctaacgttgctcctacgttgaatggtgtcgaaattgcacacggtgcgattggcggacagtcggtcgccggaggacagcggcatccggccatggtcgtcaacgggccgcgtccgatgtaaggactaattgccaccgtgactatccgatgctatgcgtgatccagggcatctagtaacgtttggtcgcgtcgaaggtcacgttaccggctgttcgaatgcgacgcaaatgatagccgatattgtaggagagacgtgacgtggagaatgcgcgagttctagcaacacgaacgaaattgcatattagactttaacgatgcaggtttttatctacacaatgaagtcgcgagtgcgcgtgcccttatatgtgcaagtttccgcccctaatcagaacggaacgcacgtctttatcagtgctcgtgtccacaaacgagggaggagaaatcccagtgcgtccgacacagctactgtagcgtaggtgatggtagctcccattaacaggtataccacagctccgtctgtcttatcgttttcctctaattgtaaaactttctccatgaatctcggatcttgaaacaccatgcggtaagaaaatactccgaatatcaccgcccccaacgtagacagaataccaacgaagatttgctggcagttatccataggcatgacatcattctttatgtttctgtacatgtaataagtttcgaggagtaaggtaccatagaacactgcggtaatggtcgcgcccaggatcagaaaacgattgtcgtgcccgtccatcgcgtacaccagaaatataatacaacacgagggtcggagaacaaatgcagatagccaagagagcacaacataccgagtaaatttggggttcatgtcacagcttttcgaaatagtgaaaattgaacctgataagtaagaggacatcgtggcatactcggccgcatcttcgcaatcgatatcgtccgaaacgcgtgtaactattgactccgtgtcttgcatattcgtctctaactgttcatcgccaatatagtcgaggagaatatcgcaatcggtcggttttgttgtatggtatccacgcctgtaccaaggcatagtgccactcgagaaggaccgtttctggccacacgtaacgactttgtcttctactaaagaccacccggactcggtacagacccaagctagagctcgagaccgcggaaaatggatatcaaatacgaacagaagatcttgtatagaaacgtccacttttatatctcggaatgcggccgcatagcttatttcttctgcggtggttgtctcatggcggtcgggcgaccgcctaccgatgactcgcaggcagagtttgcaaaatttgggctggctcttcgaggcgatggagagtctaaacccttggcagcttatgtacggcgggaattgcttcgtagaggaatgaaatgggcgctgcctcccggcgacgatgaattattcatcgactgtatggcctttttgaatctagacggggcgtgcagtgaacgtgagatttgcgatcttgtttgcctggaaacgtatgatccggagatcacaaaacacatggtatccacgaacgtcatttctggattgttgatccagacggcgcatgagtcgccgcgggactgcgtgatccacctgcccggggccccacaagttacagacgcacattccaatgctgtgtacgaatgtaattctggtgcattcgtgctaacttgcgcaactttggtggaactgcccacgtctctgaacgatctcgtcgaagggttgtttgacggtgtccccatccccagagatgcgctctcgtcgaggtcgcttagtagacgaacgaacgtgattatcacgtctaccaaagccgcggaaacgacgactatacagcggatgcatgtcccgcgacataaacagaggggcaacttaaacaccatcgcagctactttgcgaccggtgaaaaaacacgcgcggtttagcccgttcgtgcaagtaaagtatatacctcgcgtactcaaaatatggagttgtgattcagatagccattcgccgtccctaaaggagttgcgggaattgttttgtaaagtggacatggtccgtagagaaaacatgtacgcagaatcgcaattggaaccagagtccgtcacaagtgaactggttctgatagtcgatactgtatttgggagaccgctcgcaccatttattggcgtcgggtcggaaaacatacgcgtctcacatttccaaaagttcttactgctccagggcgtccttatattaaatcgtttgccgaattgctacggaccgcttcgggagctgtgcattcagcatgcacctgccggtgaagagtcgcctcctctggtatccgactctgttatcgcagacatggcgaaccatatgtttagggtcgccgtatttattggcatggttgtggaaatagttgcgggatgtgtatcttttgcatcagaagaactcgaaacgcgatttcccagtgcgaccgcgtttacggatgctggcattctactgaacggcatagaagcctcgccgaagccaaattgcttgtcggaacttaaaacacgcaaactcgctcttatcctggacggtatttatagagacatggatcctatagacgttgctctacaggaatcggtggggctaaatacagcagagttattatccgcagcaatagatatctcggttatgtctgcatttgagcattcgggatggtgtagcggctacatggaacactttgtttcattgctagatgcccgtctgagagagggagggtgcttggcaatattccggtagctttgtagcacagcggcgagacgcgcataggcgtgccgggcatatacagaacgtaagccaagctggagtttgtgtaagtatgtgctctacagcgtgcgggaagggcggttcgcgaataaacacaacagtacaggttcgacggttagaaagtttccagagtttattaattagattggcccctcaagatcgtctttgcgtcttaatttctcatatccatggtacctaaagttgctgacaagcattttggcggtgacaatcgctatagctgcggctattagtacacccgctgcagtagttgcgatgtaggtcgccgagaggatggcaatgcgctgcgactcaaacgctaggatcctcacgactgtgccatttggatacagcaatagtgacgtgccatacaggttactggtggtggggttgaaatagcgcacggacgaattgcctgctgctagcaattcccgctgcaaatcgcgcgatgagatataaatcgcatgtcgaacgtggccgcttgcggaatatcgcagcagcacgcagccgcaatacggacattcttttcccagaggcctaggtaaaaccgcaggactgattatacctgatgtcgacgtgcacggcagcctggcatatgttatgtaaagttggttgtttacatcaacgccgtctacggtatacacgatccctctgaccccggcccgccttgttacaatgtagctacctataccggagatgggtaacaccagaagagtgtcggattctaacctatcagtgcccgaacattccaaaacctccgacgcgtatgtagcaactgttctccctattgatgttcgcagctttgcaattactgattccgccttggcctgcagatcttcttcgattctgaccccctgagaagtattctctaaatactcctctattactggacggtaaaccacattggccatcgcgtataccctgtgacgccgctcggaaatgtcgatcctcaatgatgtcatgcacggcgtatacgcgtccaaaatatgtacgggctcagtgctgcgagtgagtctgatatacatgtcttgcaccgttaattcagcggccgcgatgtgttcttcagtacacatcgatgatgcaaataacagagatttgcgtgcgttatgcgatgcgcgccattccatcggcgaccgctgaaaaacgctgtcgaatgcataatacagggcgtgtctcgtggaagcattccacgagatcgcgtccctgacggattcttcgtggagagacgtgataaaatttagtgcgaggtcggaaattcgcgccccccattcgcccttctcccgaggtatgtcgaacgcgtacacggaccggaataggtacaactgtcgcgcaatacctaaagaatgcgtccccctcgatacatcgctaattttttttttcaatacggatgttagtatagcagctttttcattccatacatgtgtccgcgataataagaagcacgtgccggggtccgtgctcggggcaaaattgcaaagtgccgcggcgattactttcagatctgcctcccttttaattaattcatcgagggagacgtagccagacttaaaagcggcgtgtacggacgcaacaagcgccagaaacaaacgcgtcgttacgatcctaaagccgtggatataattactagtagatgcgggcatagaggcagaaataaaaagccgggagtgcgcttgagtgatatgaagattataatctaataggtcatctacactcgaaaccatatctgcgtgggcctttaattccatatccgaggcgttctgatatgttcccagtaggtatgtcgaaaggagatgtcgagaggatccgttcatcgggtcatactgcttcatcggtggccacagcaaagtcatgttggtagtccccgacgataatattagttccacaggcgatgcggcttccatagagatcgtaacggaggcgaattgcactcctaccttcattaagacctccgcggtatttgaaccgaatatcgtcgtccgcacgtgggcataatctgtcgggactagtgtgtccatggggtccacgaagcatgcacgctttgcaaaagctcccgataattcgctgttgagaataaaacggttctccggagtgaagaagtcattcggctttatattttctaacactgttggcgggtttgcgccagtaggttgtgacttggcaccaccgtgagcttttggaccgggtttgtccggtgtctttttttcgtctcgtcgatgggataatacggctgccgtcaacgagtaatcgaggtccggcttcgcgttcaaaactttgatcaggttattagacgttagcagcctagatatcggtcgtttgaagaaaaccatttgcttcacttcacttattggtaaatgaaagagaatgccgctcgccggcgtagatgctcctatatatacaaatgtcgcattgtcgcgtacccaggacgtcgggctagtagcattttcatcggccgatgaaaagtccaattttacggacggcggtctccggatgtctagcagcgaccatacggaggggatattatccgaggtgggggctcccggggaagatgcgagcgctagcagtaataaggtgcataccgccattccgattacgcggcgtcggtcgttgcctctgcgtatcgctagttcgagctcgggtttccgaagcaacgtaacacacatatcctatagtgtacaatgtttcgatgcaactgaaagcaacgagctaaagcgaagatgttttgcaggcgacaagggcatgcattaatgcacactcgtccgaaatgtcgtagtctcaaatgtccatctccttattgaatgcctgaacgtccgcctcgatctcaaatacatcattccagctcatatgcgttattaatctttccgccattgaatccataagatactctgcacatttctggaccgacatgtcgctgacatcaagccgctcgacattgatgttcctcagtttcatcaacatcccccacaatatccacccgtataccgttaacaggctaccatcttcactgcataattctttccgcttaaaaattggcaaaagcgtgtgctgcaatgacacccggctaccatggtaacctgaacggggaccatctataaatgtagaggccatcgatgcatcaaaccacgggagctgcatccactctgtttcccattcgtctttactgtaaggacaaatgcaattcgcatacgcgacggtatctgctaaagccgaatatgccgcattgagcgccctgagcatgcgcacgtctgtagtttcccccgctctgttcctggccgataggcgcttcaggtgctcggtttcgtcgggcaaatgtgctattaccaagttgcagccgggcggttcgtggggcaaccgtgtaatcgcactaatcaacatttccagagaacaatcgccaatcagatgtcgggcgatgggaaagcagacggtagctgaaacaggatggcgatcaactattaatataagagatgggttgccccgtgttccggctaattgatgacatttagatgatattcgttcgtgtagtacaatgaagggatcggcaaatttggcctgcaaagccattacgatcatgctagactgaaatagagataattctccccgacgccggcgttcggaagcgtcattcacagctgcaactaaatcggtaaaatagcgacgccaatatttcagaggctcaaaaactttcagcacgggtactcccgtcgcagagtggctcggcacttcgtttaacatcgacgttttacctatagccaatggcccgtcgaggtagacgcggatcagctgcgcggatgtcatctgagagggcattaccgaccacggccgcacgtccgacatgtccggcgcgcaagaaaactgctcgtagacgatataaccggcggagaagcacttctggacgctcaagttaccgtgcggctgttaacctcaagagaactctagcggccggcgttcgatgtcacgcacgtttttaccaaaagctctacgcagaatctatgcaccttcgaactcaggccgatgattggacggggcgggccctatctaagattttaggaaaaattatggggtttgatgtatttaaagcggcaactgatttccgattggtctttgaagtaaatctggggcggcgaaaaccggactgcatttgcatgattaggtgcccccgcggtctatgggaggcaagttgtgatggcgcttgcgtcatcattgagttgaagacttgtaggttctccaataatctaggaacggccagcaaaaaggaacagcgcctcactggaacaaaacagctcttggattcaaaattgctgattgactatttagcgcccgtaggttcggagcgtattttcatctgcccgttactagtattcgtgtccaggagaaaattaaacgtgttgcgtgtaacctgcctcagaagaaacgtcgtaagtaccgatttccatcgtctcgcaactttaataacgcttgcatcggaatataagattaaacaggtcgacaggcgcagaacggctgttcggaaaccggctcagtgtgcaagaaatttcgcaagtcttgagaacgcgcggcgagacgatcgatcggaagaggtcgagatacacacttttcctaactgtagtattgtcctaccacctcgtaccattctacccggagccgcgaatacgacaatgcaccgtttggcaagtattgttagctgcttggtacggaagcagtaaccgaaatcaacggcaccctacgaccagctatgttacacggtgcaatccgcggcccttctcccgttactttcttgctccgcagcccttgtccaacgtcagttgtccgtaggcactgcagcaaagcatggcgagctttgcctgggatgcaagaattttgacagacccgggcccggaatctcacccggctgatgtaaagaatttcatagcacctccctggcctctgcacttctggagggaacctatatttagcggcaatcttggggatgcggaacggcaactggcaatcgttaaggcgcgaaacagtgccgcgattgcagcgttaactagtttggacgaccgtactgatttaattgcggtagaagtggagcgtcggcttcgaccactagaagataaaatggaacagatcgcaacgactttggcggatttggaacgagctgcttctgcggctgaacttgccgacgccgcagccgatgaggctcaaaatgtcgtcgattcgaacgaatgccaaaaaaacattggtagcgctgcgagtcgcgaggtccaaatagtcaggaacgatccgtcgctaagatacgactctaacctgtcggtggatctgctgaatattatctatgccagcaggggcgctgcgaattcgggagtggcgttcggtacatggtaccgtactttacaaaactcccttattgcggaaaatcccagcgctgcgcggaagatagattatcgcgatggaagaatgtcgcggaccttcattgcaacggcgataacgtccttacagtcatgtgggcgcttatatgtggggacgcgtaactattcttctttagaatctgcagttctatgtctgtatgcgttttatacaaaaacgggagctaatgtgtcccatccaagttcttttaagagtgcattagaatctgttcccatttatctggatcacatgtcagcgagcctcgctagcactgataccaggcaaatctacgggttcgataccgggaaattgccgaaggatagtttcgccgccccgtccggaaaatacgaacggggcgcgctaagtgatcatagcgtattgagagctctagcaaattctcgcgtgttgcctcctagtgcggggtcgatcccccgtggagacgtagccccagagctagatgccgaccagagcgttcgtaacgacgaagtcaacgctgccgccgcagcgctactgggacgagcccaacccctcttccttatggaggatcagacgttgctgagagccactttggacacaatcgtggcattgcttttacttcgccgtctactttggaatacgaatatatattcagctagagttaaaaaccagttccaactgggggcgttcgttccaggcgtgcctccagatttaaccgtaggagcctcagtagacacgccgggggatgtaattaagagtgacgggagaaacttaacctttttatttcagagatacgtagttcccgtatatagtgttgtcaaagggatagagctcacacaactctttccggggctggtagcgttgtgtttggacgtcccgttttccgatcgagggttatatagcaccaggacgccgccatcgcgtatcattgacgtttcgctgagtaaatatcaggcctccctcgtgaaattgatttccttagagcttcaaaatcgttcccgcgctaatgttgtatctgtttgcgaggtgatcgcgactcacgatttggtgactctgcagtatgagcgaggcttggaatcgctgatgcaagtccagcgtccccgcacccgcttttttgaaaccaagaaggctttggcgttcaatgtggaaacggattacgatctgctttatttcgtgtgtttagggtatattccgaggtccgtatctgcatcgtgaaatatacgcaaaatattggcacgtgtccagcttaaacaacagtttagtagaaatgaatccgacggagaaatattcctcggtatatgtcgccggatatttgtttttgtacggtgcagatgatggcagcgaactgcacatcgaccgcgaggatattcgagctgcaattccgacacctgctcctttgcccataaacatagatcatatacggaactgtaccgtcggagccgttctggcactaacggacgacgaacacgggctgttctttttaggaaaaataaattgcccggtgatgatacgcacgctcgagacggccgctagtcaggaaatattcagcgaattcgataatctcaaaacagaggagagggtattgtatttgataacgaactatctaccatcggtgtcgttatcttccaaacgtcttgaacccggggaaaaggccgacaaaagttttctggcacacgtagctttgtgtttattggggaaacgaatcgggactatcgttacatacgatcttactccggaaaatgccattgaaccgttcaggaagctttcccctactaccaagacggccctactatccgaggggcaagaaacagagcggctcttaggcgataaggtctggcatcctagtaaagaggcgatgtcaaccgcgttgttgggcaccgctctgaacaatatgttattaagagatagatggcgcactatttccagccgaagacgcatggctggtatatccggccagaagtacttgcaggcgtcagccttgaccgcactggccgagtcgatgacgtccaataacgcatcaacgatccatccaatcggcgaaaccgcaaactcggacggcatacaaaaggatgatcgaattgaagtgtgcgccacttcgccgcaaacgaacaaaaccttagagtccagagcattttcgggagggagtgggttcgccgggactcatgcgatctctccaccgccccagatgagcgcacaatcgccaaccgagatgtctatgaatactaaatctcatttcccccccggcgacgatttcatttgggttcctatgaaaagctacaacgaactggtgtcgagacaggccacgcacgcaattaatgcccccgaagctgcagtggggagccaggcaccgtatagttcctctccgttaatgattccggcgcacttgggacagcatgctcacattgggggatatggacatgcctccaacccgcaatttgcatcgggggccataaattacatgggcgggtttccatatgctctgcctatccaccccgttccaaccggccaatcgtctttggaaaccaagctgtcggctctactggattgtatgacgagggagaaaaaatcagtcgatggggatcgcggacgtgacgacatgttctctggccaagaagaacgaggccggcgcgggcgcaagcgcccgtacaactgtgacaaatctcccgagcaggaaccttattatccaggcgaattccagcagtccgagcatcgtaacttaagatgcgaagacggcatcgaatacgggcgagacgcgactcaaacgaggcccgccctggcgggcctcgtgaacgctgttacgtctttgcagaaagaagttgaacggttaaacggaagggcgcaagcccattcgataccggccgtacagcatatgcaaggaatgggaaccggattccaggcccccgtatactacgcataccctcctctcccaataccacatgtattttcgcggccgccagaagacggccgcccaatttcttccggggagggaagggcctcgctaggtagcgccacgggcactcctccgtctggatcggtacctccgaacgcttctcaagaacgtgtcgatgcagctcctaaaagcgacaccgttcagtcgcaagatactgtgaacgccagtacgatcgccaatgtacatcgcgccgacgatgcaggcgcggatattttcattaaacaaatgatggcttaaatgatggcaggggatccgctatgtcgacgtataagtttatacattttgcgaccgcaatagcaaataaaagtaaaataatcgtatgcgcacgtgagaatttatttatcgagaaacagcatcgcgctaaacggcatcgtcctccgaatcagagtacacaggcgataatctatcgtagtgctggccactactttttagcctcagctttgttaggtgattagaaagaatagcagtggtgcctcttgtttttttgcgcaaatcattttcgtggcgttcctctgcggacaccaacgccatatattttatcatttctcgagccttctgtaatttttttttatcgattggtgccttttccgagtccggttcttctccgtgcaactcgcgcgttgcctgggactttagctcttccgtcgtcactggatatagggctttcatcgggttgcctctaagcttgtttacgtaccagtaagctagaaacgcagccacgagtcctgctataattatcaatcctaccgctaaagctccgaacgggttagacataaaagcggacactccagatacggtagccaccacggcaccggcggcacccacaacgaccttccctatggcctgaccgacttgccccataccgttgaacaattccgccaggccgttcataaaagcgtaatttgtatctacttctattactttatttatgtcataaaattttagttcgtgcaactggttgcggcgagccacctcggcatagtccaataccccgacatctcgcaactcctctttcgtgtagaccgacagaggaagaatttctctgtcttctaacagtgttaagttcaggtctacaaacgtgctggctgtctgtatatcagcaacctctaccatcttaacaaagttatagtcttcgaacagagcgtatgcggatccaaacaggaagtatctccgctggttagccgtacacggttctacggcctccagtgttgggagtagctcgttattttcgccgagctggccttgtatcctcccctggttctcgccatacgaaaacaagaccagcgggcggctgtagcacatattagtagacgtggcgaccctcatggaattctgcaatgttaccgattccgcgtcgatcccagtacaagtagacacggcggtcacatcccctaacattttagccgctacgcgtctccctaaggtagcgctcgcgatggcgctcgggttaattttcatcccttcctgccataaagccagttctttattttgtaattcgcaccaggccgtggcgattcggctgaacatgtcgttgatatgagtctgtatatggtcgtagagaaattggagcatggcgaattggacggacgaagtagatcttatcgtagcgccttcgttcagcgccagtttttccttcggcgcattacggagctctcgccgcaaacgggacaaggagacatttgttttattggaaagagcatgcttattatgtactaggtctagcagctcgtctgtcctgttgtccctcatcagttctcttagatacatgtgagccagagatttcgacataacgggctgatacgccacaagaaatccaccgagggccaaaaaatattggaccttcccgaccttgacgtggctgtcgttatatttttgcgcgaatatgcgcttgattgttgtttcagcgtcgcgctttacgcactgacctagcctgatacgatccggatcgaattcagtggtattgctgataaatgttgacgatagctcgcgggccatgaatctatacttgccgttaaccgttgcgcgcaacatttcagtaacatctttccatttaaccatcgagcatacacgagcggtctttgctgcccagtcccacccaaccgtaaaatgtggagtgacgaggaagttacgcttgacgggtatgctcgccttctgacgcttgctcagatccattgggaaatagccgtctatctgcctaaattgttctagcggatagcccatgggttcggcggcggcctcgggcggggcgacgccataaaacggggacatatttgcgatatctccgttcgccattgcaaaatacgagtatgggaatgcagccctggcatccatttcttccactatgcagttgacagacgtccccgtccgatatacccacggagacccccatacggtataagtgtcgttggtcgtatgccacgccttggactcgggggtgttgaattttgacggttgtagaagtacctgtttttctccggcgtcgccgtcgtatgcctcgacgtatacattgtttctcaggtatcgcgctttggaggaacatctccctttcgcgtcgattacatccgtaatttcttcgatggaaacgggagtcctatctgtaaacctgttggtgatttgtctgtacgtcgtcccggtccaggtcgtcgtttgtataacgttcttataataaagcgtgactttgaatttgtatgggtttatattctctttgaagagtatagcaattccttctccccattcggtggcctttagcggttcggggcattttcgcggcggttctaaccggaccacggtcgtaccgaccgccggtgggcagagaaaaaatgaggactcgtcttcagacagctgtacgctcgagactgcttcccgcgacgttacgttttgggccctcgcgactcggccgaagaagtagaaaaccacagatatgaaaagtggaacgcagatcccactgaaatggttcattacgggttgatcttaacgagtctcatcgatagtgtggaaaggcgcgccgcggtacgaaagatatcgcactggtcaagtgggggtgtggtcatggtttgttcgttccgcacgtatctgatccgcagccgcgggagccatgtactgcagaatggaatagagcagcgagaaaacatccgcatcaaggattacggtcacgttgtctgattccgcaccgaggaccgttatgagagggcattctgtttcatatgtgacgtatattccatcctcccatatgtattccacgttaacattgagcggcaagcaatctgcacgacgcaggtgcaattcaccgcagctgaacgcggaagaaaataaagttgtcgccaaaatcacctcttttatatatttccaagccattctatgggccgcggttatactatctatgccgtcgaagtcgtaaaaccctctgaatttactgacgatccagtcagacgaactgcaactatgaatcataaatcgcgctatttcctccttcaaatgcggcaatagaccaacgttctctacactgaaatatagcgctgtattcgaaggttgggcgaacctatgtacatcgtgattaaacatcgggccgtttaacaaccgaaaaaatttgtgagttaggctggggagcatcgcgggatctattctgtgcttaagtaatgacgtttgcatgaaacggtgggcgtcgaacgcatcagcggtgatgcgattatcgatgatattcgtacatcgtttcctaatggcttccaataacctattcctggagcggaacccattgaataatgtcgtgtatgagtctatcaatatttcaccgtatacgttaacccgcagcattttttccagctcctttctttgctctgtaatacatttatccaaacttgcgagggatcttttacttaggcgctctgcgtacattttgcgtctccgagcaacgtcagccgatgccgatcgtaccaactctaaccagtcgtagtgctcgcggacatcgggtaacggggtaaccccttcgcgaatccgtagatgctcggagttactaaaatcgtcctcgggcgcgccgtcgccgtcctggcataggggaccatttctcgtgctatgcgaagtcacttgttctaaagtagtcttcagcgcgtcttgcgccgcctcctccgggtacaataaacgttttagcagaggagtcgacatatgatgatcgtaacatgctcttatcagcgcttctatgatgtcgtctggcgctaccgccctaccccccagaagcaatctgtcggccgcattcatattctcgatttcttgtgcaaacacccgttcgaaatgatccatgcgccgcccgaataccgtcatttccacgacggatgttctcagatcgaaaagacgctctttgaatgctaaatcttcgaggttgtccgcaaacgagtcaatcgtgtttgctctcggttggttaggtttgcgttcggacgaggcaatccagaattgcagctcgctaatggcatacagattccccgatgccggcaaaaaaacgttatgcgcgtccaggacggcggttgccgcatcggcgacagacactgtatcgccgctacctccgggatccttgtctccccttgtcggtctaatgagcgaaagtgccgcttgtacaaccgaacgcttttcgtcggacagacaagcggcatgtgggatgtgcgctaccatgtcatctgggtggacgcggagaacgatctgcttagttacatgattacatatttttccgattatgcgcttatgtgccgagtctccactgtttgccgtcacgcatagttcttcaaaacaaacggagcatggttgtgacgggtcgcacaactccggcgaaacgaccgatcccgcgcccagagtttcgattagatatcgatccagggccaacataaagttttctgcggttcccgcttttacgattaggtgacagtaattgagttgcttcaatatgttttctacgtcgtgtaggaatttaatctcggtccgcaccgaaccgccgtaagtatccaattcgacgacttcgtgatacggacagtccccggatatggtcatcgacttaataaaaaagccgtgtacatctccggtgtctgtaaactcgcacagcgcacgcagcagcacttctccgtctagtcgagctctacgcagagctaaccacaaaccgtagctaaggggactaatattcctctcgagttgctccgtcagcccaggagccattaggttttccaaatagcgtaccatgagcacatttaatttcagcggcttgatcattcgcacacctactctcggatcgcatctcttcagcagctctacttgaaacaagtacgattgcaactgaccccatacagcgagcagtttctgactagcgaatatactgtctcgctcaacgtctagcgcttgtgcgtttccgtgaggcatatccaacgtctcggttcgcctcgtctacgctgaattggacctgagtcggagggagagcatgatgatatttataggggttagccgataacgccccatccggaataagacccacaaagcgatataagaaagagtatgctgtatatttcatatttccgtatacaggttgaaaagccgacaatgacgtagtatctatcttgataaggctatgcgagcaggccccatccgggatatgagctaggtagttcgatacaaaagtaaacgcgtttagacccaaacacagattttaaaagcccgcaacccacgtactgggacaacaatacacgcggttatagcatatccaccgatagtcctggagcccgcttttcgggaacgggctccaagtcaaaaacgtccgaacacggacgtttcaaagttggctctaatatggacgggccgtccgcgcgtctttccgtattctcatcaagagcatcgtaattaaacgtaggtccgtccagcgggagagccttcgacatatcgaccatctctttcgctaatatcgcggcagcatcgacactccaaccgccctcgcatccctctacctgcttgttaagttcatctatcaaagatgagatgtacgcatcgttagttatttccatccagtcatccagttccatttgccgtacacgatctccaaccattttcaacgcgatcatatatacggcggcatgaggcgctccgcactcctcagataaaaccgcccgggctctatccacgagcgtggtttccttcaagcccgaggaaaatccagtctgttccgatacaaagccgaccctaggacatgccatgacgaaacggtgggttctattaaaagacattatggagcagacgtttctcccacccattatgttgccccagttgccggattggaatacttttgtgctaccggccattccgtgatatttactgatgctgacggctatcacaacaaagggtttagaggccatgataggaccgacgagattagtagatgaaaaggcagcacaccatgcttccttatgatcacagatattttttagcagttgctgggcggctggtgccacatctgacccttgtgtgaggatatgttcgatccagggcaggaccatagccggatccctaggtcgcttggaggttgcaaccaaagccgaaatcgtgttgataaagaaatgcttatgtgaacagtacctcaggatggtattcgctagataaaattgagccagctccccgaagcatgtaggactgatgttaatgtaattcatatcggcgtagctattggtaaaccttttaatgaatgacgtgttctcctcggcatctttggagagtataccggccggcaactgattgcgttgtaagaggatccaaaaccagagagcattgggagtcgtgccattaggcatcttaacattcggaaaaagttgcgtgtgataccgtttgagcgcaaagccgagagggccattgagcacatgcatcgcttttgccggccgttgatacgcttctatcatgcccgccagccgggattttgtagcgtcggagacggtactggaaacgcctccgacgaacataactttattcttcactttaaattcccggaatatctcaaatgtaactttcactagatctccttccatgtgcaccgccagcggatcatgctgagatttgctaggatcgggaacggagatttgttgatcctctaaggtcaccgttatgtttttagatgtgatgaacccggcgttttgcaagtccagtacgcgccgcctgagtaccgcttggaactgagtcctaaaatttctagcctctacttgttgcccgtgcattatcatagagcactggcttaacgccatatcttgaacgacggcaattatcgtgcgcctggataaaaatgagagcacgggacatatgcctgacgaatacggctctattgccagcgaaagggtatgggttgcatcacctagcccttcgcgtatgttatattctctgatttctgtcaaatttcgcatcagctggccagcttcgctctcgattatattagccattgtcgatagagcacgcataaacgatttgccatcccggatgatggcatctgcgggtgtcatgtctgctgggtcctcgcatgtcagcaaaccttctttttctaacgctttcattactctttcgaccgtcagcttgtacgtgtcctgcattacactgcggctcgtctctccctccgatcgtttgagagtcgagaatggggcgtagcttcccagcgcgttcacgtcgcagtagttattcgtcatagatccaaagagccccatagccccacgcatctgatacccgaatttcggcaatcgatattctaagcgcttaattgtggtatgggcgcaataaatacgcgacgctttgtcgcacaaatcgcatggtacgtccgcgtccatggcagatgaaacaaatttcacggtatctaaatcgtgatggcaagcttgagatccgccgtcacacctctccaggtagaacaagaatcttgccagcaattgcggacaaaacccacacgccaaaattaggtaatctaacgagtattccgacgggctggccgatgtggctttggacaaatcttcgcccggaatcggcttgccgtctctatcgattaacgggtttgaggccaaatgcggcgcggctatttggaaaaaccgataaaacgaggctgcggtcgtacttgtgtcttttccgtctgcgctactcgcttctcccacctcggtcatgtatataaccgaattcgaactaaacaccattgccccgaccagtcctgccacgcgggccatatacgcagacagcgcttccactctatctgtatatccgatcggactgcaatagaggggccatttctttacatcgggtatagactcctcgtagaccgatgtcgcgattacgttttctatggacagagtagcgtcggatgccattagagaagccgtcctacgttcataccccccgccagatagctccatgccttcctttttccccgctttatactgcgatttcgaagcagattcgatgggagtgaatgcgttaaaagctgtatctgcgggtaacaatgttccctcgtgattttcgtcaaagcttaaatgggcggcacagcgcgcaatcgcgtctacattgcgaacgcgaaggcctacggccgcggtactgagcacataaccgtgtaatagacgacataaggaatcattatagaaagcctttggcataagagctccctcgcctagtgctctaggcttcgtactaaatggatcgctggcaacgcggttgaagtccgggaaaaccaagtgcaggggatataacggtattctacgaacatcgacgccattaatgctcacgactccagtaccaccgtaatgtaaatatgagttgcagaggtacacggcctctttaaataattcggtcactactaagtagagcatagtttcttgaggattcattccgagattatcgcatatttgctcgccggttgtttcgaacgacgtggctaccgggggcgaataggtgctgtagccgaatcttcctcgtgccaaatcacatgctttagtcagattcggagccttcgtgcacggttttatacattctccgccgtgaaacacaaacacgcacggatggtaatgcgtcggaacgagcttgagagtagttgatccgctacccagacccgttgtcttcgttcctgcaacagctgccacgttccacatgaaatccgcttcaactgtaagacctgaaacgagaggcaatatcgcatcctcgcagtcattgctcttggccgcgaagatcgagagatcttcagctggcatgctgctcgtgggtgcagcatatacatatcctatcggccccccggtgatcttaacgcttttccctacatccatggttaaggtgtcagcgtttatccggtagactgtacaacggaatggcaaggggcgatgtgccttccaaagctgcgaacgccggcttcgccaggagatggcactttgactttctcgtgccggatgttttaaagccagaggacctccaaaggatatgacgcaacacttcctaaagtgcgccacgaaacacgtcgcgcatattgtatgttttataagtcctcgacttcaaacttgccttctctgtaagccgatatgtcagtagatggggctagaacttttttcaacccgtacctcggtgcacgaaagaggggacgggatgaagatagtaccataccgccgctaagtagaccgcgggacggggagagataccttcggcaacatcgcaatgcgattacctatatagcgactatagacgaatttaaatatatcgcccccaaatgcttagacgcggcggaaataaagcagcggggcactcatatcggcaaattgaaacgctcgcctatactgtacaaaaacggagaggaacgtgagttcttgaatttcgaggctttgggggacgcgtggccacggagatgttttagctggaataacgtatcattcttacccacggaattcgacccgcgtttttctaggtttcatgtgtacgatatgattgaaacggtagagtttgcaaatggggcaacaggcagagataaaaaccgttttctggagctattgcggcctatgggcacgattattaccatgatgggaatgactgaatgcggcaggcgcgtggctgtgcatgtctacggcgtcaaaccatacttctatatgcgtaagatcgatgtagacaccgcctgcgggagtcgatccacccgcggactcgctgagcagatggcgagcgtggtacgctcgtctgtgaacgaaagcgcaagaaaacgattttacggctcaagcactgtgacggccgactgtttcgaagtggacgtggtacgtcgtaaggatatttatttctacgggacagattgcgaagagtattaccggattaggtgtcagagcggcaaattcgttgcgctcatatgtgataactttcacccctccataattaaatacgaaggcagtgtcgatacaattactcgaatggtgctggacaacgccggatttagtacatttggatggtattccctaaaaattgggaattgcggtgagaaagtacaagttcgagcgccccagcaccatgttacttcatgcgacatcgaaattaattgtacggtggacaatttgattggtcatccagaggacgatcactggcccgattacaagctcctatgctttgatatcgaatgcaaatccgggggagcgaacgaatgcgcatttccggtggccacgaacgaggaggatgtagtcattcagatctcgtgtctgatgtattcggttcgacaaaagcaattagaacatgcgctgttgtttgccctcggttcatgtgatcttcccgaaaccttccaagagacgtttcgtgatacctatggcgttttgcccgaagtcctcgaattcgacagtgaattcgaactgctgttggcgttcatgacttttgtcaagcagtacgccccggaattcgtaacggggtataatatagtcaatttcgattgggcgttcatagtgaataagttgaccaccgtttacggtattagattggacggatacggggttattaaccaaagagggacgttcaaagtatgggatgccggggcaaacgcatttcaaaaaaaagggaaatttaaggccaccggaataatcgctttagatatgtattgcatagccaccgagaagttgaagctgcaaagttacaagttagacgtggtggcggaagccgcgttgggggagcggaaaaaggagctgtcgtataaagaaataccaacgcactttgcggcaggtcccagccaacgtggaattataggagaatactgttttcaggattcgttgttggtagggaaattatttttcaaatacgttcctcatttggaactgtcagcgatagcaaaattagccgggatattgctatcgcgagcggtattcgatggccagcaaatacgcgtgtacacgtgcttactacggttggcgggctcgcgaaatttcattctgccgaataagccgcaggtgcgtgcgggaaccgagttcgaaaacagcatcgccagtacggatgaatttgaaggcgaaccttccccttcgaatccaaaggcatcctcatcatttcatggaaatggcggcagagtcgtcggttaccaaggagcgaaagtgttagatcccatttcgggattccacgtcgaccccgtggtagtctttgattttgccagcttgtatcctagcataattcaggcacataacctgtgtttcaccaccctaataaacgacgacagaaaactcgccgatctacgtccacgcgatgattatatggaaatcgacgtacaaggaaaatcgctgcattttgccaaaccccatattcgagaaagtttactgggtatcctattaaaggactggttggccatgagaaaagcgatccgagctaaaatccccgctagctctgatgatacagctgttcttttggataagcagcaggcagccatcaaagtggtctgcaattccgtgtacgggttttgcggtgtggcaaacgggctattaccttgcattgatgtggccgcgaccgtgaccacaattggtcgtgacatgttgcttacagtacgtgactacgttaaggttaagtggggaaccagagatgccctcctccgcgaatttcccgcgctgacgaattatatgttgggcgacgattactccgtgagcgtgatttacggtgataccgattcggtgttcattaagttcaaaggggtagcgatacagggcctcgtcgcaaatggagacgatatggcaaaacgcatatcgtccgatttatttcccaaacctatcaagttggagtgtgaaaagacattcgacaagctgttgcttataacgaaaaagaaatacatggggacgattcacggtgggaggatgttaatgaagggagtggacattgttcgaaagaataattgccgcttcattaacacatacgcaaaaaagttaagtgatttgctatttcaggacgatgcggtggcaaaagcagccgccctcgtcgcggaaaggccttcgtcattttgggcaacggctcccctaccagaaggcttgaagcccttcggggacatattggctgaggcatacggtcaaatgacggcaagcacgttgtccgacgtgggagatttcgtcatgtcggccgaactaagtcggccaccgcaggcctacgctaacaaaagaatagctcatctcaccgtgtatcacaaattggccatgcggtccgaacagttgcccatggtaaaagaccggatttcctatgtcatagctgccgcaacgccggaggtactgcgcgatgccgagcgggtagcagaagccagaggggaaaggaaattccgctttagcgaggtctctgtcccggaggttccagggacgtttagcaacagcgccaagacgcgggccgtccaaaaacccaaggtattgatctctgacatggcggaagacccgacatatctaatcgaaaacaatattcccctcaacacagattattatctatcacatctattaggaactctatgtgtaattttcaaggctttattcggcaatgacaccaaaacaacggatactgtattaaagcgatttattcccgaaacttatacagaggatcgcgcctacgcgacgcgagttgcgcgcgccgtctttgcggagatacgcagcggggccggtctaagttctagcgaggaggaagaaactcttcaaagactgaatagagctttccgtattctaacagaagttcgccgtcgatattaatgtcgcatagcttacagtacacgtcgtcggcgttgacggctgggacatcactcgaatctgtttgacgatcgtattcttttctaatgactaataaaaagttaccgcgccacacgtgagcgattatgctgtaattcttacaggccgtttttaaacaatcaatcaatttgtagtggaggtggagagctttcccggggaacacgacatacatcatgtattcaagggagcctgcttcctgatccaagtaaaacaacaccttcacatttttcattccagaatcgagtagcacatagtatgcgaaaaaaagttccgggattgccaaaatacgagaaagggcaatttcgctatctttcccccgctcctctccgcaccccattctgccgcccaaggccacgatagaagccatgaaattcctataatgataaatgttgtttatctgttggacatatgccaatatcaaagaggcacgatcgtttcgccccaatcgcgggtctccgctagccgtgcacgtagggcaacagccaccaactccgagataataccccattcccgacaaagacaaacagttatctgcgacagcttccgacatattgaacggcaacgagactggcgttgtcttgatgatcggcacagccaaatccttgactaccattagttcctccgatggggactcttcaacgaaatcgaagtaagcgcgatacaaatcgacatctggttttcgagacccgcgtttcgtaccgcatgccggcgcttgtagatctcgccattgccgccgcgaccgtcttgctatccctccgctacgccctacagatctgcgtcgtatgaaaatgcaaccggtcatgccgggaattacgatgtcacacgtaggtttgtagcgtgtgctcgagagatatcagggatatagagtgtctttgaagaaatgcgccagcgtctttgacgaacgcggataaagtagtcggccggggagggaaaacctgatatgtcttgaacgtgtacgccaaggcccaaaacccggcgcatacgcgaccttcgaaacggttatggcttgcgagccgagctttatggagtgccaattcttcccggctcgctaggtccgggtggtcgaacaatgaccgtggattggtctgcgctatccgcgcagcacacatcgggtcgcaaaagaagtgtttgtagattgcttccgttcccgtgcctttgagcagcgccacgaagtatccgtcatcttcaaaatcggcatttctctcctgcgtcccccacgcctccaacaccggttctatgctatggaaaatgccgatgttgttagctgaataggcaatgatatcgcgcttaaattgccgcattgcaagccagtacgtgcggattagtaggaagttgcacaataagcattccgcggacgttccccctttggttatcgcgtgctttaattgtgttaccattaagggtcctaactccaaatcaggttctgagtcatcttcgtaacagtgactatatgcccgagtcgcccctctagcaagatctattctgttgtctttccaaaacttgctgaccgtctccttcctaaatttcgctgccataagagcgagttcgctcgccccatctggtgcagatcccgtgcccgaaagcaataataggacgagattcgtataacccatagtagagtcctcgccgctcgaccgttccgtatactgagaccgattagtgcacggtgctagtgcaccaagatcgttctccccgtcaggcagtgctttgctcaaacgaagctgcaattcgcgctcgtaaatatcgtcgtccgacaatgcgcgtataatgcaactttccgtttgagaaaaattacattctacgcttctcgcgcagtccttccagcctgccaaagcgacggaaagcgaggtgggaattgagccgaccgtttgacccgtttgtgggactttccttttactttcgtgtccagctgccgtgtcgcattggccctcgtacgacgagtgacccatgtcggacaccgtcgtcaacatggcccgcgtagcgctttgggccaaatacgaatagttactgtacaacactttagcgtcacccgcgcacagcgaccgtcctcttttccccgccgaacggccttgatttgcacggggcacgataacctcgttatgccgtcttcccggtacccccccgtcagttcgaaaacaaccatgcagaaagaagtgtctctggatatcctcaaaagttaaatgctttctcccaaacgagcctaccaacgtgcaaccgtgatcgaccagaaaatgcttatccattatatacacgaattcgaacgctgctataaacattgttgtagcgcatggtggagaaccaagacatttggaacacaaaaatgcgtaatcggccatccatatagccgataatccgaatttgtgcttatatatatctaaaacacggcaaacgagacattgtctatctagagcaaaaacctcggctgccgtcccgataaacgtcgccagctcttgatgctcgattccgtcttcgcaatcttctgcgctttcgctaccactgcaactctgaccagcctgaagactgttggtcttaatagcgtgggcggagagtagcaattcgttaaagagcgtatcgttgtacgtcaatatttcaggatcgaacgctatgtaagggcattttaaggactcctcgacccatccttccgacgcggatgctcccggagatcgaataaacggtagttcgacagtacgatgggccatggccgctgagacaaacactcggcaagtagatacgcctcggttagccgacgcgatcccagacgtagagttgctgtcggacgatgtcgataaattagctgaacgctatatttgcgacgggatcgtatatcgcgtatggttcgaatacctaatacccgatgaattagatttgattttcccgacaaccgacgggaagtttaattatctatcattcactagaagacttgcttctgccatccgacatggtcgtgccggagctgggagtgcgacccctacgtcgtttatcagtgccgagcgtgtctgtgaccatggggccgttttgagagggcggagcgagagatttgcatccgtaattaataggttccttgacttgcatcaaattctgaaggattgttagaaactagcaagccgaacataattgctccgccgtatatctttttttcttttacgaaggcatacagcgaatgatgagcgcgcctcagagtaagccctgtcgtcgtgcaggactaatagcacggatcaggctcatcgtcggcggagatttaactatgggcaattccgatcccggactcgcggagtctttttccggtcgcgttccggcacgttgcgtatttcaattcagtggggcagacggcgtggagagcgcgtttcccgttgaatacgtaatgagaatgatgaacgattgggcggggggtgagtgcgatccctacattaaaatacagaataccggcgtctccgttctaatcgaagggtttttcgctcctccgacaaacgccgctagagcgccgctgtgcgccgacaaagtgaacgtcctgttaaacactaccgattctacgggcgtcgttttatctgatatcaaaaggtttaaaaaatcagtgggtgtggattgcaggcctttccaggcttgcctaaacgttcattgctttgtaaggctaccaaatgttcagctggccttcagattcgtcggcccgaccgatccggccagaacatcaaaactgctcgactcggccgtagcgtcttacaattcgaaagcgaaacagcggttcaaaaacagttcgagggctatcgataacgaatcgagaccctgcgcacttcatgagtgtgttccgatcccggtaagagatgaaacgcagaaactgactagccaatctgatataaggacccctaggcgcgtgctgaccatactcaagaaaatttcgagcggtgagtacgtaacgaccgtacgcgtctcgatccgcaaaattatactgtgcctggtcagtgtattcgtagttataaccgcctggtggtgctacccgctctaaaacctcgcgacgcggcgtcacgtttccagtcggaacaccgcaccacagagtcatcatcggcgccactacatcgcgcgagactgcaatgtctcgcacgccctctccccagctttcgcctgtttcacaagcgttcgatccctccgacttgagcacttacaagttggatgtgctggttaactaccccctctcggatttggtgcatcaccttaatgccataccgcgaaacctgcaagtttccgacaggcattccgacctgaacgcagctaaaatcaacgttttacgggctctttgtgtgggattttctgacgtgcggcgcaaaaatgatactcgcactttacaacgcacgcccatgttcgcaatcggcgacgccgcatcgcgcttgagaccgtccattggattgaaacggacattccccacgggcatattctcaacaactatcataaactctcccgcagacgatgatgcatagcttttgtgagtcgacatgctttaataaaaaattatccaaatcgaacgagtctacttccctatgtcagttatccggtcaggagcattttgattttaaatatctctatcgttaatgtatcgattctggctctcaattgttgtcgtgcgtgtgcgatttgcctggccatcttttcgcatgccctagtgagtgcgtaaagcgcgctgcgtcccacctgcctaaaatcgcgccttgtcaataatctatcggcagagattactcgggacgcgctcgattcgtccgtgctggagcgatcgctatcaggaacactagattgcgactcgccatccgtgttagaatccacggacgatagagactccagcgcaaacagatatcgctctgggtcgatattggagtcctgttgcttattttgccctgcttctgcttccgtgaccacgaaccctctgtacatgttgtgatggtcgtgctttgccgttgtcgccttgcatggcgaacgtcggcacgtattaatgggtttcgactgcgaactagacggctgcgcgggtctcgacagaatgtttcccagaaccgcactactcggcgacgaaggctccgctaatataacgtccgggggcgcaaatgcgaagtggtcgtacagtccgtgctgcgccggactcccgaccgccgcctgctttttgccaccaggtgccgtcgagatatcgacggagcggtcaaccggttccaggttaagatccgcggtaataacggctggcgacgctcgttgtaacaagggagacgagtcgcggcgcacggaagcgagtccccctaaagtatcgcatcttggccttgacgcattgttaggacgaacacgggcggcgcccttgtccgagatccgtccgattgaatcaatcctcgttccggcacgcgacggcttcagcgctcttatccctattcctccgtcttcgtcgtcgggaatcagggattttgtcgaagacgcgacaacaaatggtgttgaggtcgaatcggagtcagatcgatgtggaatgtttggagttccatgctttttcctatcatcgcgtaccgagttatccgaaataactacggcaggggacttttggtcgagagcgcagccgggtgcgttacacgcggctgccgtatcggtaaattttagcctcccacgatagacaggctttggcatatcgtgcgcccgttcgctgacatcgatatgttttacggggcgccccttctgcctctcctcgatcccgactgctgcgtaggtagattgctcgttatgtgtttttttagttacgacgagtttttgagtggctggagataacagggacgggctcaatgtttcattatttgggggggcgagcttatagtgaaaggcgagtttggaagaggcgccatcggaagcatcggtgctaaccgtagaaggacactcgacattctcgggaactacccggtcgctacgatcgttcaactctttatgaaacaaaaaacccgtttcagcattgtcgtagacgtccttctctgcagccatcccatcccacatgctctctctatcccgactaaagtcattccctggtaattcttcatcttccgacgccgttccaatagatagtacatcctcgacatcgccgtctcggctcttgttgtacacggggatcggatattgtctagattcgtcggaaaaaaaattagccgcgtcctgtcggtcgagcacggcgatgtcatcatatgacgcgcccgtttccacgcgaatgcccgcatctatgtatggcagttccgagagaacagcgtcatcgctggaagttagccgtattacggggatagggtcgaataccgtcttaggccatagaactttcacgggaaccattcccgtgtccactatcactaaacacggaggagcggaagaaaggggcttggaggctatgagatgggacaagtgttccagctgttggccgaggcatgcattttcgattggattgctgtcgtctgccaacaatttccccccccaggaagtcgtgtcggatgaaacggcggcaggttcgagaaagcagccctcggagccgcttctcgagtcgaaaagacggacacacagattcagtccagagccggaggaatacgcttctggacattctgcggcgatcacgatccgtgccccgaataatgtagctgcggctgccagatccatagcgtttacttttaagactccgctagggggtgtggacgtgacggtaaatgtcatcgccactcctgtgggttcatataaattgggaccgtctgaacctttcgggatagttttgtcggcgggacgtaacacggacgatgtggtcacgtctaaagtcgaagcagcgtccccgcgggctgtgacgacgtcatcgtagcttctacagctttgctctatctccgcgggtagaagcgaggaccacatcaccgccaatgcggttggcggaatgcacatacgagccagcactgttgtcgttgtcaaaagattcgacggcacgaccgcacgaattttggcaaggcccgtactcgtagccccacctacaccttcccagggtttaagggggtctgtttcggaaaggctgccttgtttccaatcagaataccgcaaagcaaaaagggatccgcctgacgggtcccacgctccgcccgttaaactcatcggtcggcaattcgagtccgacggggcatctttggatagctgcgtagataaacagttgataaacgccgtagtggacagcgactcattgatagcgccatagagcgtcttatccataaaatcgtactggctaataagatcgagctgggaaaaggtcaagacgtgccccggcatgcacgtcataatagcaaccatcacgtcggccaactccagccgaacgggtcgtccatttgcagctatttttttaagcccctttttgtcggcggcaggggcgacttgccccggaagaaaaaaaatatcagacaagctagcacccgttttacgcgtgagcgtaatggccattaatgcgcaataaatggacccgatcgcttttactgtgccatccgccagccaatcgtagttttgcgtacgtacatacttggtgaaggcgcggaaattatccgccgcggcttgaacgaaacccagcctcaaggccatgatgtcgcctagcatgcccgcggcaactaccatatctctagttgacataacttttgaagggatcgcgggcctcaggcttaggccggagggctcgcacaaacacgcggccattttttcaccaacagttcgatagcagacagaatatctcaggggcgcgtcggaggcgtctaaatatgtatggatgcctgggatatctatttcagaaaacgcctcctgcagcgtgacaacaactgatggtctgatccaagcagctactcggtgtttaagatatcgatccacgaaccccgcggccggtctgttgttcgcgtcagcattcaatcctgtatcagaggggaggagcgatggacacccggcaactcccggcaaaatggcggaatatgcagcatacagcgccaatctcagctttacaagccgcgagtatcgagttacgtgccgaacgtaccacttggggagccgtttagagagaatatcgaattgcgaggctattgtactgagatcgtttaagacaaaggttggcgggatctttgcacacagagtgtccatctgtttttgaatcgattccgtttctttgagggccgccagaaaagcatccatgactccggctctgtctctgtatttcgcatcgataagtccgatgattttagccggcagcctagcatactctgcgttatcgcgcaaagcgttgatcgtattggaagagactttagcgcgagcagcactatctcgggcggcggcaaacccctctgagctcttgtccatcctgtccttatcgtgcataaacgtggaccatgtgtcatcccaagcgacttcggcaagcgctagttcggattttaactcgtccaatcggctcgctaagtccgcgagagcatcgatccgctccgcgtatatagtcatcggaccgctttcgtcgatccgggaagttagctcgtgcgaatctatgacagatcgggcgtgttttagccactctaccgtttgggtatccaattctttagtttcttcgactttactcaaaagtattgccgcttgagtgactatgtcgttcgcagtttcagccttttcaatagctttcgctatatgcggaggcatcgcgaccagccgcagcaggttttttaaattggccaattgctccgccgtctctctgtctgcggcataagaaacttcggccaaactcttcagaataacttcagctctcgatttcgcgccctcaatagctgtcgttacccgcagctttattgaggagacggcttctatatcgcgttggagagtatgagcgctatactctgcataggctgtcccgttgaacgccgtaatgtcttccttttccaaatcgttggttattgtcagtatggcgttcgccgaaggaatcacgatagagaccccatattcaagagcgcgacgcgccccctcagggctatacattctagccagattctccaatgcctctctaatttctatatctaccctccccgctgcgtgaagagcctctaccctcatttgttcatgccgagctaaaaagcccgtaaattcctcatgcccgttacgataaaaatccacgtatttggccaacgttgggaccgctcttacgtctggttcaatttcgcccaataacgtgtaatagtccaagttcccgccgcgggcatccgcgtgccttaatatagcgagtactatcttgattaactgtagcaaggcgtcgcagctaactccgaaaagttttgtgtaataaggagccgccgctataaacgcgtctagccaggtcatatttttcaaaaatgctataggaggcagaattccatgaattctattcggggtggaaaacgggttgaacttcaatacagtttctatcgcatcgtgaatcgcacgaccatgcgacataacaattttctcggctctggctctgaaacggatagtgtcgtagccggccaccacggcccttttctccaaatcactcatctccatagcatcaaattcggatttcagctcggcattggatagtagggaatgaatcgaggaaacccaaacgtcttcgctatgcgatctctgggcacttatcagatttctctcgtaggttgtaacggccgcctccaattctacggtccgctgatttacaagccctaccgattttgccaggtcggcaattttacgttggatgtgggggtccgtaacatgcgcgtgactctcgagagctgcgatggctgtattggcgtctctcgcgctctgcagcgcgtgagctatttcagttctggcgctcattataacactggcgtcgctatcagcggctgctgttttgggatctgaagttttgaccttggttattgacgcgatcacgctattgagtgccgcgcgcactgcccgatgtagaccatctaaacggtccccgtgctgcgccacgcccgcggccacctcagcgtcggataacagcaccgttaagaacgaaaacgcgtcatcctggcctgcgggtagatcggccattattcccgtagagggagtgtctgcagtcgccctgtttacatcggatacggcgttctgcagcgccgtaacagccgccgtagttttttcgaccgacatcggttcgaggcgcgcagcggcgactgctgcagaaagcgtatcggcatgtttcccgaaaaaaaccgacgcggccggataacccccaattggacccaatattacgcgtatggccagagagaaaggaatgccgaggccagataactctgcggcagtgctcgtactggggtgtgacaaaattgtcctatactgagagaacaacagccacaaatccgttcgcaaagtcccaataacatcgggtggtgcgagagctagaaaggtctctagcggccccgtatctccagggatggattgcgttatggttttgactgtcgagtccaatgcgcgcaacccagcaaacctttgtagaggacgcagcatcagcttaatcgaagaatataaagttctgatctcctcgtaacgatattgaagtgccgcaattaaggtttcggcatccagccgcctacgggcgatagccgcgcggtcatccgaacttagcaaatttgcaaatttgtcgccccctaaagcatttgacaattttactaactcaaccacatccttcataacttcctccagtttttgaagatcggccgttgtctccaaatcagtgtatgacgcaactctagcttccaactcatgtaagcggtccaaatccgccagggctgtttcacggcgggcggcgttgttgttaacggcatcgacttctttgatcagtgtttcaaactcttgtcgactaatccacccgcccgcttgaacggctgccattgccgttttccataccgccagattttctggattttctaaattagagtcattttccagcagatccccgagcaatttagattccggtgcagttgttacgggcggcggggcctgcgcgccactacgcgccgctactagggcaataacatcatcgagcacagataatgatgcgaacagcctggccattttttcatgttgctcgacaacgaccattttaaatctagatgtgctagccacgttggctcgaagcgcattcgcgctatagagagcccccttcaagtaatattcgtgtagtgcgttgccgactgcatcaacggctgccctctcaatagcagtcaagcgctgtgtaacgacagatggggagactttagctatgctctcgtcgtcgcgcgatccagaagtacccccagatcctcccattataaatgcatcaaatgaggcgtgcatcaatcgaacgccggcgtcgagggcctccaattcagctagtatgagttccgccttcctcctggcaacagtttccctatcacgtatgaacctgcacagcgatgcgactctgtcggtcaagctctgttcggcatgcaaagacgtcttctctgagtatatctttcctggattactattaaacgcgcttactaacgatgtcgccatcctttcgtagattctatctgcatccgcagtgctcgcctctctctctatagagtccaaagttttgtgaagggcatctgtgagctcctccacttccagagccactaataccagcttgcttagggccaatttgcctatcttggaattttcagaaagtacagattctatgaggtctgcagattctccggctcgcgaaaccgccattcccgtagaatcaatgaacgcgctaaagtgggcgggcctcgtaaatgctttaaataatgatgccatctcggcttctacgacagatcctatttccgttgtggttcgagcgccgttttcgataacgtagttgaacaatctggtaaaagtatccagcccacatatatccagaagtccgtcatagtcacccgaccgtgacaagtggatggtcattcccatacttaaagctatagattgctctaaatcatcgatgttagcattgatgtcgctcagaatagagctagggacgtgttcgcttgtccatagcccgtctcgtagcgactcgtccccttcccccgctaccgtgtgaggattaaaaggtggccggtctcgcaacgattggccgtgcacgaagtgctcagcacgcgcctgagaacttataaactcattgaaggagacattgtccggccgggtagcttcttcttgaccaggtatattatgtgtcgtgctcgatccactatctgcttgttcagacaaacttatcgatggagccaccggattgtccgtataggtcaaacatcgtttagttttccgggacggttttctgctcgaagattgaccttggccatcgacggataagttctctgaacttgacggaggagtccatacagggcgcctcctcttatgtctctcaaaagactgtttgggcggggagctagatttcgtgtcagtttcaagccgaactacattttcccgcgttttgggcaaatcaggccttgttagcaccgacagatcatcgccgatgtccgggaatgcagtggtccacgcatttacgatggactcatgattggttatatcacatatggcatcaactggagcctcctcgggaggcaggacgtatgcgtcctcctccgcatagcccatttcccgcctaacatccacatcccctgcagcgacgggagaacgatcacttctggaatcgacagcgactttgatgtcctcgctacgtgacgtggaggttccaatgatgatcctagttgttgtaggctgtggcctgtaagggggatcgagattggccagcactactttaatgttctcttcctcgttaaccctgcctagatccaaaacgatgtccgctgtaccgtacagccgtgatacggctgatattatttcttcctttggcggtgtactggagatcatagatacaaagtaaacaaaggtcgcggaccactctggcgccgtcgagggatccgcataggacgtgagatattgataaaaataaccctcgcttactcgaacgatacacgcttggcctatgtggccatgaccgtgtggatcgaaaatgtagattccgttatcggatctgtacacccctattcctatgacgccgatgacgatcaggcaataaatatcacctcgtttctgcttccatactttttctatgaatgtccgcgcagatatttgggtttctaagatagtggaggtgttttcatctacgtagaagtccaattctccataggagctcgaaaacgcaacacacaagttgccgtcgggctcatttgataagatcctgtttggtaaatcgtgagggacgcaagtcgtataccttccatcgcgagaggtttctattgtccattcctttccctgcaataacagtctatctatggcctcggtcgacaataccgcatccaacccatacgcaaaaactacgcgcagaaacgccaatgacgaccgcaagcatgaaaccgatgaccccggactcaagtccggggcaaattgattcctgttgccaacggcaactagtgtaaagtcggtggcatcaaccaccattcttgcccattcatctaggattacctccgaatccatgtttgttcccgaacgcatggcgcggttttgcatgttcgagacggagctgtccctcgaattatccgatgtttccaagcgccgcgtcgagggactcggttgtaaccgcgtagatttcttggatgggcgtgtagtgctccctctactctcactagcagccatatagacgatggggcggaatggcgcgtcttttcagattgcgctttgtcattgagcgagttagacattaaaagttgattaactccaaaattgtgatcaatcagttgcggccgcgtaagtggcgtggctgcaacatccaagtcggcacgaacgaacgatacgccaggccgtaaaacgatagacgtgtgcgtcacgcattgcgatctctcgcctgcctttcgttattaaacaccgtatcgacaatgtcgaccaaaccgtctacagttactctcggttttatgaggaagtccttcgcaaaattggcaaggtccacatcatcgtgtgccaccgtatccaaatccaatgtatcaaaattgagttcgtcacgatgagttaaattgtgcctcgatgtcagttcgactactagggcggggctatcgtcggttactacgggcagacggcccagcagggtcgctacagctgcgtcgatttcgtcgttcgtgacacggtcttccatatcacgcggaacctcgatccgatcagctattttttgccatactactcccacattctctatagcactggccaagtcctgcgaacttctgtcacgaaacgtagaatttatttccgacaacgtttgccatttgtccagcagccacacgatatcgccggtcccgggcggcgtggaacacgatgtcaaggctctgacgtgcaggtccagcgaattctgcaggcgagccaatctggcatagtcggttccgagggtagaaaaatagcttgctgcctttacgctaaataaaattgcgcgctccattaaattatcgcatgtatgaacttgtttcccagtttcttctattaaagtccgcaacaccattgatttgagtcttacattcgccattacatcacccgaggagtcgtagaattccctgagagccgacagcacatcaacgattttccatgtgccaaaattggcacgcggctcgccacggcggtaaaccgttacagtacctcctgctgtaccagctgcgaatttacacgcaaagaaatgcttaaatatgtacgcaaatttaaccaactgcctggatcgctccgctaaatatgccgcacacttcaacgttctatccgctaagtaattgaattgaagtcctagggccgttccatgcatactaatcaaaagcaaactattcgatatctctggacgggggggcataatcggtctggtctctggcggtaccatctgcacggccgcatagaccacgtcgtacaattcgcccatcagcatttccagattatacgcatcgtccgtggtaggcttggccgtcagatctctagcaaacggagcgagtgaggaaattagagcattgagcttgtttctatgattcacgaaactgccaatgtacggcgcgccgtaatccctggcccaagtcaaaatttcgataacagtgtttatcgggcgttcagaaaagacagatgtcgtgatagccgacaatgcgtccacgcaaacggtagctagaatatatcttagaaaatggggagttgtgctttcaggtgtgatgggcatggattcaggatagcgaattgtcatggccagacgaatcatacggctctccaggtctgggtccactgcatttggtccagagatactctctaaatccgaatggtccacactagctagatgttccgacggttcacctccaattaactcttccggtggcacgattccccatatatgctcggctctggagtcgaaccatagcatgagtgactcctttgcaaattgtattgctcgattggcagtcccggccccgctctggcggattgcgctatccatttccgcggcgaggatcgctcgtgcagactttacatagtcctcgtggggatttggcggtatacatcgccctaatatctgagctatgattgcgctatctaacccaagtacttttatgaaatctgaatcggcgtccggaggaaggccattgtccatataattggttaagtaagtcatgccgggaccataactttccatgagtccgaaaacgatgtttccgatgacagctatgcatccgataacctgttgtacgtcgtcaaatgtgtcgagttcattaacagtaccacgagtttttcccaaatttgcctttagcgccgattcataaacccggcatgcctgtctcacaaaacctctttctataagcgcttccaataactgtctcggcgacgaactgtgttgtacagccccccatgcccgcctagccgattcggagagtttcgctttagcagcatcgagagcgcccccgccgtcatttaagtcgccatcggtaataagccggaccacggcagacatatggatcgctaaggcatcttctgttaatgcgtgatcagctaatataatgtctggtccgttccgcaacttttccgctaccatacccggctgaactgcatatacatacgggtctccgtatgctatggcggcagatgctctaacatcatatgctgttcttttcatattgtttgcctctacggccgagataagttcgcgcgagcccaatgcgctggcatcttctgcgaatagatcctttaactgagaaggatggggcgatcgcggacttttaaaatattgatcgacaagggccagcgtaaatagtattcgagtgagtggcgtaaaggccctatttgttgtacatcgagacataataacaaacggggtgatccacccgacggctatagaaattaatcgaattccttcctgaacaaacgggaaatcgtaaataagtttaaagcgcgtctgcgtcaaggaagctggtagttccaaagcattaggagcaggttgacgtccggataacaacccttcggaagtataatcaaacgcgtccgtggcgatctcttcaaaaattgtcagccactcacttattaggggccacaaaacactcggtccaaaaggacatgatctgcgcagaccgtttcgggtaagccacgcaatggcttcttctcccgtcatttcggccgccaatctacgcaacctacgagaatcgtctttccaggacattttatcccaccttacggaggtacgccacaagatgaatccgacaaaattttgggccagcattgccgcttctgggcttcctgtttgtttgtagacctcgagcacagccgcgaatgcatcgcgccacgtcgattccacttgctgaatactcattgtttctagagcctggaaaaatgatccgatagcagttcttgcttccgcagctgtagcatttccccacggttccagtggcgccgttccagccgataaagaccttagtgtatccagtaaagttttcaacgggaatctcgcttcgccctgggtttcagacatggcgcgccaataggtagggatggatctacgtatgtcaatggaggccgtataaagcttcaataataatacgttccctaaaatgctgtgctccgcaccgcagaaaaatatcgtgtgatccgcagttacaccataccgtactttatcatctccatgacgcatcgagatcccgtataggccggcccacgtaagaggcacacgcgctacataactttgttgcgtttaactacaccgccagtcctgtattgcagtatactaggtgacatacagcgatttttatgtgcagtagtgcacacgcagttgtcgcaaaacgggcttgcaaacgatcatcgccaatacaggatctctttataactggttgttgatagtggacgtcatgaaaaccacttttcgaacaagcgacgtgcaggcatccaacacgcagtcaaatgcctcggacaggctgcatgacatcttacggagcatcaataactcaatgcactccggcattgttcggcgcatcaacataggctatccgcatgcgggcaacaggcgcgggacgttgaccgccggattggaactgttgagcaatacgatcacaacgacccctcccggggcaaacatacaccgctccattgcaaattcggcaggcgaagctacggcaacgatcatacaatctttacgaacatattccggaagtggagatctgaacacgaatggtgataataacgtcctttcccgacagatcagcctgacagatttctgtttccccgatgcggagatgccaggactaattgtcttatctatgcgacatccactggatataaacagcgaagcattatacagcacacctgccggacgggacccacgggcattggagtcagcgtggtatgaattatctgaactggccgcggtatcggtaaacagattagacggaagtggtgtccggccgtccctattatcgctctcatttcttattgcttcccgcgcgggagactatgcggataaatgtggtgctgaggctgtaagagctcacgtgattagcaattacggccgccggcggatagaggacaggctcgacaggttcggaagctgccaagcagcaatgttgagatgtcacgtgttcccacaccgacatatgcaagtattagggggaatggtgtcgtggatcgcacagcgcgaaatcgccagtataaccgccgtggtcaagggctctcaagagagcgccaggacagaacagaccaacaatccaagatcgtcggtatacgttcccgcatgcgcctatctcgatttagataaagagattcacatgctccatgatgacagagcttcttcgctactatacctcgttttcgtttatgcacaacacctcggacgcgagagcatccgtgtatatctcatgcggagtcgtttaggggaatcggtgttcagagaaggcctcggttacctgtactccgggctaagagccggtaacgctattaacggtctggccggtataatagcgccacatggagtagacgcgaatacggaatttccattatcaaaagctttcgaggtacacaaacacgcctgtcgaaacaccggaatcggacctcgagactccgagaaagtggactggcgtttagatctccgaggccgccctacaaagaattcctgcatgtacgcagcatactgtcgcgtagggcacttgaacgagtattcgatgccggcgaagaagtctgaacgttgtggcgggtctgtggaggtccctgttgtatgggtgccgggagtagtgtgggatatcggagaatggaccgagtgttatcagtagagagttggctacaccgagatccggcatcataccttacgtgaactgcttacgtttggggatgtttttgcgtcggtgtttggggaggagtcaatcttataaaaagcctatttgtggtacgcttcggtctcgcgctcactgagcaacccgtattttatccagtctgaaatcagaatctaaaatgcagcgatccgatgaaaacgaatccctcgaagcgaatagaaatttggacaccgcctcgcgtaactgtactgatgtgcaggtagccttgataatggcaacgaaattgcatcgcatccagcagcaacttgcgagcatgggatatttatctggctacgattccgtgcccgatattactacacccgtgaaagttctgcgcgagcgcattacccatctagtaaatacattgaaacccgtttgccgtttcgatgagcgcgtgtactacgcctgcggggagctggtgcatttacggatcaaatcacaggaagctacttttgatgcgtggttgatgtcgaaaaaattaagcctgaaaggcgagatcgtagataacatacagcgccacagaggtcacgtagagacggatatgctgcgcttttacggagtaacctatccctggctgaaacgactgggtttacagtcggcgttgaaatacgaagaatatctgactgagttggaagacggcaaaaaagaatctctttgccagttttttgttcggctggccgcggcggcagcaaccgaagcgtcaaacaaaaaagctttcatgtcggctttgggtaccgaagtgtcgacctgggaaacggctttcacggctttttttttcgctctcgctcgtcagatatttgtcccatcgactccctgtatgctttttttggggcgcgaaggaacctcaaccgcgagctgttatctcatggaccccagaactataaatacacacgatacccttaaagcgatcgccgacgatatagttccccatctcctagcgagaggagggatagggatatcgttgcagcatttaaaccaaaaaacaggccttatgcctgtgatgaaagtattggattccttagtgatggccgcgaatgcgggggagcgtcgacccacgggggtatgcgtttatctcgaaccgtggcacgcggacatcatgtctgcattaaatatgcgcggcatgatggcgacggaagagtcccgtaggtgcgataacgtatttatcgccctttggacttgcgatttactgtttaagcgctacgagagacacgcaaacggggagaaaaatgtgacgtggaccttattcgattcccgcgcgtcgatattggccacgcttcacggatcggaattcgaaaaggagtataaccgtttagaagcggaaggtttaggcgtagctagcctccctgtaagggatttgatgttcgcaataatcaaaagtgcggcgtccaccggtagcccctttattctctttaaagacgcgtgcaacaagcactacattacagatactcaaggagacgccattgcaggctctaatctgtgtaccgaaatcattcaaaaaaccgacggaaatacaaacggggtgtgcagcttagtaagcgtcaacctcgcccgatgtgttttcgacgagaacggagagaaaaaatttgatttttccgcccttagacgcgccgtgcggctggctacggtgttcgttaactcgataatgtctagcagcgatgttccgactgcgaaatctcgttccggtaaagatcgacacagatccatgggcataggcgttcaggggcttcatacagctctgttgtcaatgggtctcgatttgagcgatgaacgcgtcaagcccctcaacaagcagatttttgaattgatgttgttagaggccatgacggtcagttgtgaattttgcgaaggcgggttgcccgccttcgccgacttctccaacagctattactcacgggggcgcctgcattttgatggctgggcaaacgtaggcttaagtatgcccgaagagtggaatgcgctgcgggagagaatacaggcgtccgggttatacaatgcccagttcgtagcgttgatgccgacagccgcatccgcacaagtaaccgaagtgagtgagagttttttgcccgtgttcagcaacatgtttaacaaagtgacgacggcgggggaactactgcggcccaataatcaattaatgggagagttgagggagatctatgcggataatgaggatcggcgattgaaagccatagcagcgttggagtgcgcgaactggtgcgtggagaccgctctgggaaataagcccgaatgctctcaattacttaaatacaaaacggcgttcgagtacgaccaatccctcctaatagatttgtgtgccgatagggcgccttttgtggatcaaagccagtcgatgactctgtttgtgacggaagcggctgacggaacgctgctggcgtctcacgtcatgaacctactcttacgcgcctataaagccggcctgaaaacaggaatgtattactgcaagatacgcaaggcgactaatgccggagtattcagcggtaacggcgaattgacctgctcgtcctgcatactataatctccaagcatcccggcattttgaccatggccacgcaagcacgcgggaacgaatttgtcagcggccaaaccgcacctctgcacaaaaacccgtgtcccgaaaacgcggcggccgtcctaaagatggaaggtatcgagatcgaaccttcgactagttccgctagagataattacaaagtgtcacggtacttctacgtccccgaatgcccagatatagggcacctccgagctttgagtattatgaaccgatggacggagaccgaatttgtcgtcgccgaggatctcggggacgtcgccaagcttagcgaagaagaaaaaaatttctaccgattcctctttacgtttctctctgctgcagacgatttggttaaccttaatatagacaatctgttaggtttattcgaacaaaaggatattcaccactattacttcgagcaggaatgtatagaagctgtccactctcgggcctatagcattattcagctgatgttattcgacaacgactcctcggcgcgcgcaaaatatgttcagtctgcgttagagtcccccgtcatccaatctaaattggaatggttagaccgacgtatactagagtgcacgtctataccagaaaaatatatccttatgattttaacagaaggcattttcttttcagcatccttcgcggctatcgcttatttgcgcacgaataacctctttgtcgttacatgccagattaacaacctgatcagcagagacgaagcgatacacgtagaggcgtcgtgctgcattttcaagaattatatcgctggcaacaagccatccaccgctcgcatccaagccttatttagcgaagccgtcgacttggaatgtgcatttctccgcgcagccgcaccacgcgactctcgcttattggatattggctcaatctgtagctatgttcgttacagcgccgacagattattgagaatgttggacgtgccaccgatttacggcgaacccagccccgctgccgactttccgctatctctaatgtccgcttcaaataatacaaatttcttcgaaagaagaagcaccgcgtactccgggagtgtatcgaacgatctttaattagcctgtgtgcaactgtactttctacccctacccacaagaattaataaatgaattcaaattatcgcttttcgcaccgtgtagtttgtgatgcatcccttccccagtaccttatcagcacggagtcgaaaggccgtacctccgggatacaccttagaaatgcggttgaaataactgaagcttcggcctcattgggtatactgcgaaacaccaattcttcaaccgctacatcgtcacgtatatcctgcattatggggaatcgttttaaaatactaattctgggcgttctgcgctcgggcattatagtcgcaatgacgtgctttatgaacttgtattcgagaacttcgcatctcgtttttggggggtgcaaagatcttaacaagctgtaattggacgcgagatccctgttcgcatcgggcatatcagccggtctctcgtaatgatggccgcccgtgatctcaggattgcaacaattcatcaacgacgaccggccacgctcgttatcgctcgctttaccgcagatagtgcccgaaccctgcttcaatgtccctagatctattatctcttgcatggatttcagtgtgtgttcgcaatggaggtctgtttgacaccgaacgaagttagacaaaaacgtgaaatagtccatttttaacgccgccaaaacatctctgcagtagatagtcggcggaaatattctagtaaggtcgatgattatatcacatcccatcaatagcatgtctgtatctgaagataacacatacgcaaccgttttggtgtgaaagaggttagcacagatatcgtccgcttccatcatggccacatcgacataagggtatcccatatagcgaatggtatccatgcagagcctatgtagaattttgggcgtatcagacttatcgctccatctgcgtggtcttttccgcttccgcgttcttttgttccgcgcttctccggtatccgcattctcgcattcgtcgcgcgaacgtacttgcagcctcccagaacctcctcccctcgcgatgcgagtagctgctagcgcctttgctccataaagcgttttcccatacttcgaaaacccccggtccgatacaaacaccggataatacgaccgttggtgtaacaaacgcagcagacagtataagcaccgcagcgtggcgaccgagttgtcgactccgtcgaccttaccagggtaaattttttccagcagtccatacataacattccataaatccacggcaatgggcgtcatagccccgccggatatcgaacccgaaatgtgacttctcactaatccgttcgcataggcgaagtgcatgcaaccgtacacgcccatggcaactttcggagtcgcagtgtaagagacacggggtaatacgaattttgaattttgggagtatctgtcaagtatattcaactcttgaataaccacgaccaggcgtagctatccaaatgccgaaacgttaagccgctccataaaaccttgattccactattcaattgtgcaatagttggattagggcaggtattcggctctatctgttcaccgtatacacgctataccgtcctttaaattagacaaggtgcgcgtctctaaacctataattcccggtagcggtataagcgacacttattacatgcctatccaccacgtgatgcaacccacacgattcacgttgaagacatgtgacatttgctgtaaatatacgcaggtaacaatgtgtgcggcgaattagacttacagccaatagtaagcgcgacataacactaaatgggcggcgcgacattcgagtgcctataggagaccgatatacgtaaccacgcgtggtgcgattgcgacccaggctccttcgatataagctttccccctcacatccggagccatccgttagattgactctgcctcagcctatacaacgcgccaaagaacagtgtgctacggacagaagtgacgccgacttgagttcacggcatcgagaccccagaaccggtctcggcgatggcgcgaataactatgagcgatgaacacatcatagacgatgcaggggccacttctaacgattcgcccaattcctggaaagtcgtcttggccggagagaaatttagaacggtatcggctgcagtacgcgcaatagtagattctgtgaagaatcccctaatcatattcagcgacgacggattaatgatacagggcacgatttgcggtcagcaaacattcgttcctatcgagtgcgccgcctttagtgaatttgaatggcgcgggtccgcggccatattcctggcgctaacagattcgaggcgtactttattagacgcgtttaaatgcgacaagaaaaaagcaatcgaggtctcctttacgttccgaggggaaccgccgtcgcgacatctaacccagacagtcacgtatgtaactgataacggatcgttctcgagtgctatcatcaagtatgaactgtggtgcgcctcagttttattcccgcaaaaaattcccgatgttacgttctcagtaaacaaacagcaattaaacaagattttggctatagccgccaagagacggcacgagcaactaacatttgcgttgaaagcagaaggggggttttatgccggaactgtgtgcgatgttataagtttcgatgtagacgggagcgcaatgactcagtatccgtataatgccacgactgcggtctcgtctgccctcgtcttagcatgcgggaagaaaagagccgcccgtaatgcacccgtgactgcatatgggagcggaaaacctttctgcctcgcactggaagacacgaccgcgttccgaaacgtcgtacagaaaattaaaaccggctcggcaggggcagatttgggattttatacggcgtgcaatccaccgatgctatgcgtgcgtccgcacgcgttcggcagcctgaccgcttttctattttgcaactcggattgcatgtctatatacgaattggaggaagcgagtgtagcggtcggcgcagtaacatcgaaacgcataaacgaatattttcccagagtatcgaccatcgattcccggaaaaggcgcccgtcttcggtcctctcggagggggatgggaaactccttaaacccgacggccaataggtctcgtgtccgcgcgcggaccacagtcatgacgcggggaggtcaaactgatataagatgtgataagactgcttagatttcattcgacctggttattcggacatacatggagcccgtcgacaacgcgtctccgttacctccgactggcgcgggacactgtcttcataggattgtttgcatcgaccctccatgtacagcaaccattggcagcgggaggagcggcaataggtgcataaaatgtattatggttacgacgggctccctgttatcgatggccgcacacttgaccgtcaccgtattttgcgtttccgtgattccgtgtatagatcgaaccgcagcctatccacgctgcactatgggcgccatcttcgcattcctattcttttttaacatgcggcttactgcacgatcatcggaaatagtgctgctcattggcagaccgacacaatttttatgcgctctgacagcatcaatcgccgacacggtcgccaaacatctagcggctacccataaggattacctgacgacattgcgagcaatagaagtaatgtctctgttgacttttgtcatgctcggagctctgatcgcatcttatcattacgtctgcatagcaacgtctggagacgtgacgtggaagaccgggtttttagttgtggcggcagggacgattgccggcatcacggctccgtatggagacatttctcctctagccggctttctttcggcgtatacggcgttagctattcacgtggtcagagacgccagtcggtctctaatgaacacgtgctactaccgtgcacgtcgggaaattactgtgaacggtgcatatcgcctcggtcgcgcgcgtctcccgcccagcacggacgccgaggcgacgcgcgaagaagacgtatccagttacgatacgctgggggggaatattcctacgataattctgagcctcatagcggtcatctcgattccagccatagccagctttcaaaagtacatgtcgaacgcaactaagcaccagtcaacattgactgacacgttacgcagtatatgcggtttcttggtgggtacaagtgtcgcgatattccttccgtcgcgctaccacgaggttctgttccgtccaattcttgtattactgttaatattcggggcaatggctactaccttagccggcttcggtttacttctcgggccgacattgttttccgcgacagccgcggttctgtgctgctacacttgtataaatgtacgcaacgcgaatagcggaataaagcaattggcggccgccgcagctggtaaatgcatattaggaactgccatctcgagcatgttggtttgcgtgttaatacaatattcctgatcgcggagcgattaatttttatatcatgtgctcatagcgttctttcgaactgcgaataaaactttcgtggctactaaaggggcctatcgtgggtttatgcgctgtcgaaaacatgaaagggccgatttaaagctaagttgcgcaggcagaggccactccatatacgctctcggagacgcggctcgcacgccagctgaaatattttccccatgcacgcgtcacgcgcgttgcgagctttggggtggacgagactcttatttgtcgttttattttcgggccgcgtcctaagcgctagcattaaccccgatctagctacacccccggtcattgctttcaacccgtcaagtattccggccgatgatgggcctttggccaaagttcctgcatccccgccggcaggggagaaagaggagagccacaagaatgcaagcgacgcgcgtaggatgcctagtatagtttgcgataaagaagaagttttcgttttcctgaacaagaccgggcgtttcgtgtgcactcttaagatcgcccctccctccgacaacgaatggtcgaactttgctctggaccttattttcaatccgatcgaataccatgctaatgagaagaacgtggaagcagcgcgtattgctggcctctatggggtgcccggatcagattacgcctacccgcgtccttctgaattaatctcttctattcggcgagacccccaagggaccttttggacaagcccatcggcacatggagacaagtacttcatatggctaaacaaaacgacgaatacgatgggcgtggaaattaggaacgtcgactacgcagacaacggttacatccaagttgccatgcgggatcctttcaatcggcctttactagataagcacgtgtacatccgcgtgtgtcaacgacccgcctcggtcgacgttctagccccccccgtcctcagtggcgataagtacaaggcttcatgcatcgttaggcatttttatccaccgggctccgtctatgtgttctggaggcaagatgggaatatcgttacaccacgtaaggacacggacggaagtttttggtggtttgaatcagcccggggagccaccctggtatctacgataacgctgggcaactcggccatcgaccctcctcccaagatttcatgtctggtagcctggaagcagggaaatatgatgagtactacgaacgccactgcaatcccgaccgtatatcatcatccccggatatccctggctttcaaagatgggtatgcaatatgtactacgcaatgtgtgccgttcggaattaccatacgatggttagtacacgatgaacccaaacctaatacaacttatgatactgtggttacaggtctttgcaggaccctcaagcggcatagaaatatcatcagccgaatattactccaagatgactggcagaaaacaaagtatacatgtcgtctcatcggctatcctttcgacgaagacaaatttcaagctttcgattacttcgacgcgacgccatcgacgagggggtcccccatggttctcgcgatagcggctgttgtgggactagctttgattttgggaatgggtacactcctgacggctctgtgtttctacgcctccgggaaaaaatacatattactttcgtccgtctagtttgcggtgacattgatctggctcattatatgccccgagctcttgtaacatcgcggacgcgatttccgtagtaggcacatctcaaatgcaaaagcggcatgtcaaccgtataggtacatccggccctgcttacagtcggtagggcatatatccaccggaaaacttcagctttagactcctcaggtgatgaggaatagtatgtaaccctctagcagtacggtatttctaaaaaaaggtagatccttttccacacggcacagactaaataacgtacactacacaggttctctcgaacttcgtttggaccggaattattccctcggcagcgcctaaaaagcaaacctctagagtagataagtgtcagtgaacctaggccttctttgttccacggctggaaagctaagggacgaggtacacgcgaccccagccacgcacgaacagagtttaacggaagcgtcgtttgcgggataaggttgtcggaccccgcgggtccgttgaaaagtggctgcgcgcctaccgacgaatacgtcggtaacaattttagaaatcgaatatgactgcgagtaccgtacaatcgcgaaatacggtctctatatagctactcggtccttaaatatgtaagtatgatgtcccctactcccgaagacgaccgcgacttggtcgcagtacgtgggctgctccggatgatggacgagaccacatctgagcgacacaaacgttcgcgttcaggatgcccccggttgttatgcggttgtacgatcgggatcgctcttactgtgttcgtcatcacagctacggtcgtgctagcttcgctgtttgcattctcttacatgtccctggagtccggtacatgtcctcacgaatggatcggtttaggctatagttgtatgcgcgcgatggggagcaacgctaccgagctagaagccctagatacgtgctcccgacataacagcaagcttgtcgactttactcatgcgaaaattctaatcgaagctatcgcgccgttcgcctccacggacgccaatagcagcaacgtcttccgactacgcgatagtagaacaacgtgcgtacgccccactgccgcaggaccggtggccgtcgactgcccgaggacctgtaccgccatatgccagcggccgcgcccattgagtatcgtcgcttcgataatcagggacgcccgtacttctcttcgtctagaacgtcgcgaatattacgaagtttatacggccattctctcaaatggcagcgtgaaataaacgcgagagaccgagcattagagtagcacttatttattctatcgcagagaaacaccgcgtgatgcggcactcgatctcggccataatggccgttaacccgggaagctttcgccgcgctttagtaaaattaccaggtttgcagacaggggtcccgcgggcgggcagtctttctttcctccgtcgtaaattaaatcatgaaagcaatagttaggcgaagagcagacatcggccgccttcatcttgcacgcgttccgcaggacttttgtccatttgattacagtcccttccggaacgtttctgggatcatcttccccgaggacagcctgagtgccttccaaaaagaggacgtgtcgcgtcgcaaaagttaggcgcgcaagacaagaggcgagaactatcactaacatgttcatcctgcaatatgctcccaagcctactcaacaggggctctccccggctgaattctcctcctaagtgttcagaggcctctgctgtaccatataactatcgtgtacgcccctcccagtccgtgtccgatactgccccttttgagaggattgggagattagagaatcgaaatgattggagagccacattcagacttaatcacatttttattgagtcgggcgagcttagcgcagacgggttaacaatcgcaaccagttccacaagttcactatcctggtcagcccccttgtttatttcgcacgcaaccatgggtccaaattttcgcgattcccttctagtttgggaacgttcttcgtcgtcttgcgagaccgtgtctaattttcggtgcggggtgcacatgtttctggtgacgatggaaattacaatgacgaggccgatcgttgcgctcacgacggcagccacggttaccccaattagcgtagggctcattgtcccgagacggacagtaacgtttgaattttcgtttgcgggtgtcggttcgtaatgatccacgccattttctagccagggaaaggtaaagtgttccgcttcaagttcggaggcgctggttgcagtgacgggcgtcggggttgtcgcctcggcgctggtcgtcgtggcctccgtggcaacgtacgcttgccagttgcgccaactttcctcggtcctgagataggcctcaagttggacggtaggtaatccgaaggtgcgacacgaagccttggaatagagtccgcgagtcgcggcggtgttcgcgaattgatacaccgatagttggatcgcgaagacgtcaatgggttctttggtgtcgtctagccgaacaattacgtagaacatcccgctgtcgttcggacgaggatttcgtatagtgagcttaaacgggtgtggaggtccggttagtctgttcgaggcggagaacgtgtactcggtcactttacagccgacaaaaacagaagacgatcgatgagtgcaattttcaaagcgctcctcgctaagttcctggtagcactggtttgttatatcagaccgaaacgcgacgcggacggttcctgagtagggtttgtggggtctctggccaggcatgaaaaatagctgcagttgaattgtagcttcggggcgaggcgcgacgatcacgatgtgatcgtcgtcaatcctggcggagacgtgatttccagtgatcacgattcccatcgcgccgaagggtgcgagcgtcgcggcaaggagagccagagttccaagtagcgatgccatgcttttcgaacgtcccaatgaataggcattggtatgctattccatgtgatttatattatgagcgtgaggcgtggcatgtaggaagaaaccacctattctaggctcgattagctacgcgcgcattttacgatgctccaaaccagtagccccacgagcgcgaccgcgcaggctacgaacgccgcgaatatgggcatggagacggcattagaacttttagtagtctcctccaccgggatcacggcgggcatgtcattgtaatagtcaggatccgagtttggatcatcgtgctcggtgtcctcggggacttcgtcgtcttcggggagggcggcaggattttctccagaagcctctgcctgcatgtcgtcctccgagtcttctggaggggccttcttttcgctgctttctgcgtccggggtgcgcccttccgctttcttggttacagcgggaatttcttgcgggacgctatctggacgagggtctggcgcgctaggattctttttcctcagcaaattattccagcgctgcagaatatcttcgtatccccgatatacgtcgtccgcgtgtcgtgtattggtgtctgcgatcggataaaggtgttcgccttgaaatccagtctgatactgttctgttgtccagcatttcgacggtaaaaagttaagctgcgacccgatctttaaacagcgatcgttaacttctagagttacgagagctgtttgcgcaaatctcccgattttcagggtcagcaagtattggccagagagcgcagcagtgggggagaatatagtcagtcccgcgccatttcgcgatacaagggtgctaggaacatagtccactgcccacatctgtgcagattgaacggcgcattcagatagcagttgtacgtcgccacattccctgtactcttttctatagattggacagtacttgtcctcgccgtcgtcgcccttaatcacgtagaaccagacgacggaggcctcgaaagggccccccttctctttttctttggccgccgatatcatgtcgtccacgttagaaatcgggttgagctcgacaacgtcgcagcctcttgataccctagtgaggtatctgttatacgggccaaccgccggtatggttagcgcgtcgagcgcgcgacggcctaaaatgtagtcgtacgtgacggcggcggtgctctggctagcgaaggaagaaagcagtacgatagtccaaaaagcattcctcaaaaataaatggcggtccatagcgttgcgtacaaagcagatatgctcccgcataatcctgacacaagtccagaaaagagtgaatacagctgcgcctgagcagcaccgttttccaccgcaatccatgtgtttgttaagcacctctcctttcgcgtagtaacgcgagtgccgtctgagatgaggacggtgcattcgtatatattgcctccccggccagaaatccacgcctcgcctgctctcgcgctgctcttccacactgtactttggccagcggtatgcgaaacaacggtcgtggccgtcaaatattccggcagtgaaacattattaaggctccattcgaatctcggaacaacgccggacggcagagttattgtgcagtatgccgtttgcggatcagaggtaaagtataactctggcgcgatatctttttccctcgctataagagacgtgtcgaaaagacagtaaggttccggagaatggctcgtgcacgacaggcacattagctggaccgatgttcttccatcggttactctgtagtacagctgtttctgccatttctcattactgttaaaaaccccggcgggactgttcccagaaatttcatccattacatctacgaggtctactttccaattagtttctaccctatagggagatttgacggtggaaacgcaagtcgccgttacttcgccatcgtttgaaaacttcacctctacaattttgacgtccaataggggcgtctgcgactctgccgtcgacgggggatccggcctaggcggccccggtgatgcggcactcgatctcaatcactagtgaattgcgcgttcaaaaaaaacacaggcggggtacgataaatttacgcggccgcgctatgtttactttatacatcagaggtcatcgtcaacctgcgcaaaatttccgttaccgtaaccgtgccgccacgatgcttgcgcacggcttttgggcgtggaccggtcggtgcctccaaaaggcgttcggggggcgtttcggggaccgtactgggagatccgacagccacggcgttgcacatatctgccggaatcgccaatcccgtcgtagaagcacaaccattcctttcaatcgaaaaagtggcagggagggttgcggctcggtccgatgcgggcgaaggctccgcatctgtgcgggtcccatttgacgtagatgccgtagtcggtgtcggggagcggagataagttagcgagcactgagcgggaggcggggagtcttgagtgaagtgcatagtgaagatggactgtccattagaggcaggcgcttcactggtctcgcccccgtcctctacccacgcacgcttcgattgctggggcgagtcttgcaagcatctaacgactgagtcacctcccttagccgcgggttggtaggtgaccgtcgacttaactcgtgcgtgtttgaaccagagcgccaccgtggattccgtgtcagcccacgtgcacgagttcatggtcggaaatagctcccccaggaagcactggaaccgtttctgttgccggagagcacgtctcaatgttgagttagccatgccgccctgcagccataccgcatacccgttaaagaccatgttgaggatatattgacagcggtaattcaaaagaccaaccaacgccacaatagcgactacaggccgcgatacttcactttctgggctgcttcgccacgcgcagcacgtccacaaagcgcccatgtgaacaagaggggctaaaacggttccgataaaatggcataacatcgtagtgtcggcccagctttccgatggtagggaactcacggcttcggcaagggccaaaaatacggtatcaaagtcgctcggggcccgagggccgaagacgttagggcacgcgcgcagatctaacacgtccattagccacaccgcccacgtatacaacgtccttacataactcagcaatagttgcaagcgtatcgacgtatcggcactaggcgccgttacatcatcgggtctcatgtagtaggcgtatttttgaataagctctgtcccgtcccgaatctctcgccaacatctgagatacagtgcattatctttcgcgagttggaacggtttcttgaccaaggcgttacgattaatgatagggtaaaagagcaatgctgcttcacgtctagtcggatcgcaggtctcgggcgaaccggcacggcatccatcgcgtctcatctctaaataattcatgtaagaggcctgataacacctcttgaccgacgcacgagtcagcttcttttttttcatacggcgcgcaatgcgcgcgcggtagggcctcgtatactcttccgaggcatcccctaacgcgaggtagacgacgatacattccggaactttgttagaaggagcgtcgcgcaacagcgtttgtcgcaaagcagagagaaatcctgaggggagcacttctacgagcgcgtcttcttgagctcggatacccgaaagagatgtacccgttgtttccgatagctgacacgggtactcctggacgcgcgtcggcgaacctcgtgaccgggaatttaacgccaacgaatccgtctccggctcgggagaagttggcgtaaacaactccggcgacatgctagcgcaagcatatcggtccatcggaatctatacagattaggcgcagtacggaaaggccgacttttgggacgcgaagtggccagaagcatcgctttccttagcacaactattcttaaatgcgatgcttactcagggcggattgatagtcccgcccatacggcgcgtcaccacgatctgcacgccgctccgtgcgctttttttttaccggtccgtttttttgaagatcgcctccttcgcatcttctaacacatcctgcagcgaggctagcgtgccgagaaggttatacccgctcggaggcggtactagctttagagcttccaactctccattcttctcctctccacgaatcgctgtcgcaatgccgtcgggcgggtctcctcgctcaaattccaattctaaatactccatagcgtcgtcgcggtcggctatatattcatctacgctaacaggtcgatacaagcctttacatacgtagcacaggtggcggtatagcttaaacgtttccgaccaaacgtctacagcgaggtcgtggtacatggcggcgatcgtgaggtgcgcgacgccgatattcaaatgccctagcagacgttgcagaacaatggtagtggctaccacggttgcggttaaggtgtctcccgactcgatatctctctcattcgccgaggtgctgcgcgatacgaactcgttcataagctccgtaagcgcagatctagtagcgacataagccccgacgaaagtctcccctagcggcgcgcccccggtaccataagaagctgattccaatctccccaggcacattccttccgcataaagaacatcgaggctctccattgggagctttttatgaccacggcctagcagtcgcgcccacgcgcgaacacgattagctttgaaacggtgaagcattcgacccgacgaaacatacaggaactgcgcggcgatactagcagccacacatcccacagtaacgcacgacgatagcatttcaagttcttctttcgtcacagacaccgtgtcagacgacactctcgacaataaaaacacttctgcccgtagcatagcggcagcggcatagcgcactgcacttttacacttcgatcccaaaatgcaacggagttctggccagtacgccagagagccgtaggaagcacgtaaaattgcagcagcggggcccttcgccttacggatagcgccgccttcaaacattttagcgtcacccgtaggaacgcgtggcaaagacgacaataatttggcgcgaccgaatttggaaaagccccctttatgtatcctcaccgctagctccaaagccgaggtaattaagaaaataatagcgtctttctgattcagctcgccagacactacggcactcctcagggcatctatcccgaggcagagaataagcgcgtgtgcttgcttcgccgtccgtttccaggcgagagcgccttttggtggcgcggacgtatacatatcccccttggcatagtctgatctgctgtcagaatgccaaagtggaccgtccccgaaagtattgccccgggtatgtagtaatttgtcttctcgtatagcctcgactcgaggcacgggttccaacagccgccgcaacggaatgaacgtgccaaggctctcgataaacgtcggactcgtgccttcgaccttgatgctattgagatcgggttcggccgataaaggggaagggaccgtgtaagcagatacgacccgctcgtaaggccgtaaatcgtcatcatctcccgaaaagctgtcgcttcccagagattgactcttttctctagacgatgcacccgagcctttacttatccagttctgttttaagtcagacggcgcacgctccaagctgctgtcgcgattaaatgaggttcgatcctcatgaccgccggctctcggtcctcgcctgcgtgacgatccgcggcgtcgtccgcgcacgcgcccagaccgagccgcatgtgtgtattccccccctctagatgatcttcctctaaactggacccatcttctggatcgatggcgaccttcagagccattcgagcctatcgaagaccggccagaacccctagaataatgcgtgcgcacgctagcgtttcgatgtcgccgtctagatgacgacctccgacgtctagacctaggtctcgacctcgatgaggcgtctgtcatgtcgcgcgacgcatcccggcctgaacgatccgaagagcgtccctcccgatctctgcgatagtgcgtatgagcactagcgttgcgatgacgacgcctagacgaagaccttcgccgtttagaccgaggtttagatctcgacgatgcgtctatcgcatcacgcggtacatcccgtcccgtatgctccaaagggcgtctatcccgaaaagtatctcgaatgtagccaataaacccttgtccgttgcgacgactcgtagatccggcagagctcctatatccatcagtctctaggcgatcgtacgtatcgtcgtagttcgtctctgatggtcccacgtgtatgcttgccatgttatagggacttcgcgataatcggacacgcgttttagttccgcgcgttacataatctcggaccgaaccggttctctgtcgctgctcttgaccgacatccccatgacggtgtagagccagcattcgccttcccgtcacaactcaccggcaaagtacggcggccgtccatcgccgtctcattttatacggtgcctaatcgaacggcggaaccgtagctatatcgaccgcgttccattgagaagggggcgcgaggaacggtaacgaagtaaatataataaaatcatttattagctgtcgcttttacgtacaacattgttttaactacaaaatcgtaccgtcgcatcaagtattacatcaccgtttaccgttcgcggcttacattgtgcgagcagcagcgatatcctcggcaatcgcgggcccgggatgtgtagaatcccgcaacatcgctttcacgatagtcccatggccacacgacgggccggccttcccagcgcggccgctctctccccgcgctgatgatcgcggtcttggagggtgcatgagagagtacacttccagctttgatttgatgcactggaatagatacgcggatgccctaggcgcgtttgctaaaaatgcaggcggggctgtcaaaggcataccccgctcttccactaactcgcatcgcatcaccggcagtccgagttcggaccgtacgtaattttgtgttcttaattcggcggcggttaacgcacgcccttcaactatcacaacgccgtggttaaaaataaccggttgaaataaacactgaaagtgtcgtaattggtgccaatcgcaccgcaggtgtgcaaataagttttgccttttcctctgactggcttcgagtcgccgcgatacatctcttgtaaccgaaaggtataaatgcatatacagaagtcttgcgaaccttgccgcttcccggtaatacgccccggcgatagatcgccggggcgtctctgacctgccgacgcacatatcgcatcgcgagggttcgttcgctccctgcctaagataacatgccaaagcacgacaataaccgcaaagtagagtgacataggatttttctctagcttccaattccatcgaaaagaatttttgaatctccgtaacataaacaggcaagccgtcctttgttaatgggggccgcgggacttccatcccgcaatgttcgtttagatttatcgccgtatatgcccatttctcttcggacgccgcatctaggacttcgctaggagagacggacagtagggttgcatgttcgtataagtgcccattaatcggaaagcacgagaacaagtctacgtttagtttttccagccgagataacagggacgggccctctgtaaaatccagttcgtgcaagagcctgttgtacaagcggttcggaggattcggatttggggacggaagcgaaattttgatcgaaaatggagcactcaaagagaacgaggcagattgctccgcgcatctcgtttgagagcaaagagtttcgctaaagctttcaatgccgcggaggatgtccgaatccaaacagtccgtcattccgtttacgggcgcttcgatctcggcggataagtccgtactgtcgcggcgagcatctcgactccccggtcccattctccgcgtcgccatccatctgcttagtagcgcccgccccactaccgatactttatgtgacgctattcactctcgctactatagttaccacgggaacttgagtagtggcgacgtgaagtcgtcggagcgcgaccgggggtttttgagcgacgatctctcttatctaccggagtgctctcgtcaccgtcgcgttttccatattgggatctggacttagggtttcccatatccggcgacagtccggactcctccgataattttcgcgtacatgcctcagcttcatccaataggtttgccccttcttgaatcgtgatcttgattatagccctggcgaggaattcctcgagctccgcattggtcctcggggcgttccgacgccaaagggaaagcgctcccctatatgcatggtactgggccacagcagctacggctccgcagaatatacgctcgttatagacgagcgtgtttgatcgccaggtactagttgctgacgccggagtcgtactaaaggcaaatttccctttttctattgccctggctccgggtttggcacgaactttggaggacagcgactcccctctttgggtttccgatgaggaatcttttctttcgatctttacagatctgcgtctttgtaatgaatgagacgggggggagatccggtccggcgactcgttcttggacgaatctcgtcgagcgcgggtcgacgatatatgggcactattatccggtgacgtgcgcatagttgagcgacgtcgactcgacttacgtctatccgaatctcccattgtatctcgtattaggcagccgattacagacgcgacgggccgttacgtttcaccgtgttgcgtctccgacactgatcaagctgttcacggcaatgacattcttatacgggaacagtagcgcccacgcccacacgatcttaccagccgtcatcgaacatacttgccgtgaatagtcggaagcatgcatggtacgacccggccaagagggcggagattaccgccaccagacctagataaaaaaggaccgagaagccagaagaaaaggctatagacacgcctacggcggaacacgtagattcccagaaatttcctgccacggcgatcggccttcccgaatcgatcgaagtagctcgcgactccacgagggacgcaattacgcaaattaacactttacagaccacatgatggatgtcggacaaacccatccctgcggtaacgctttggaaaagatgtcctcgcacgcgtcgggggctccgtggcgcatgcagttctccgtcgatgaagcgatatatgcgaggaacccagaaggttggacctgttatatagaagaacgcgacccgcgctgtcttcgcgttatcaacgactgtgcgatctcgttgcccaaacgcgatgttaagcggaagtatgaaatatgtgcgttagatctaggtgtacgagtggcagttcctcggaattatgtcgttgtgctggcgaaattgacggacccggatccaacgtctcggggcgtacccgtaatccgcgttgccaatggactaatagattctggatacagggggaacgttcgagtggtacttttgtacgaagcagcttgcaccattcctaaaaacgggctggttatacgtctggcgctcgtgcagttggcctatccggatttcaacagtcgcgtgctttttgacctcgctgatatcacgccccacttggattgcgggcctaacttttcgatgtcgattgcaaccgctgctaaatcgcacagcgctcaggctcgaccgctattgccccctggcggcgagaaactatggccgggaaccgggtgtcgggcactcgtctgtttgtacagcgatcgcgtgtctcgggcaactcattataacactttagacagcaatgtcatatttgccgtaaggtacaatgattctacgaccgttatcggcttaaaagatgtcccgaagtatgtgcataaaacatttgtacggttttatacatccggtcaatttgcaacgttcgttcctttttacgagacatttaatacaaagcggcacgaagatgcggcttacgatatattcgctccgagcgacattgtattggaatcaatgtcttctgtaactatcgcgatacagcagcgatatgcatgtgcggataagtcaatggttccttggatcttcggacggtcgtccatgaatttgcgcgggttgattatttccccatctaggtggatgcccgattcgtggttaacgctgactttatgcaacttaacggaagcaaaagcgaccattaaacgcggagataggatcgcccagctgttgttagtcaatcaggaagccgctgcgttgcttccaacggaaggcggcacggctgcgctgttccctacagtaggtaaatgccgtcgtcccgcagcgtccgcggaagctaagtggagggaaacggcagcattcgatacggaatcgggcaggagcgagagagagtgtgccggcttcgggtcgagcgggcaataatgtatagttgcgcacgattacatacaaaacaataaacacgaacaccacgctgcgttctggacaatcagtttattcagttacacagtccggtaacatgccctcgttgactccacatgtcttagcccttctaccgcttcccttacttacatcacatgacgttgcacatgccgcttgctcggcttcagagtgcggcggcgaaggtagccctcccacccgaccgtaaatatctgctccactttcgtccccgcagttacgggggtcagtagcttccgatagctctaagttttccgtttcgggacacgcggccaacgcttcgagcgagcaatcatttggggaagattttaagcctaacgctctttccactagagcgatatcattcatagcagtctctgtagcagcagttatttgtatcgcgtgttctacgaaggcatccgttcgtcccgtgccgacagacatgtagatctgcaagagggcggcggcacacgtgtccaccattcgctgcgcatttttgcgatgggtctcgacgaccgcgtcgagcccaggggttccttgtcccgaaacatgacgagataggcaatcgagattacggagacacgcactgtacattctagccaacgactggccacgaaccagttttcgcactccgtcggcagacaatatcgccatttctaatgtgatgggcgtggggagcataagattgacggcttgtaccgcctccctgaaacgatgcataactctgtcggaggaagacgaggtagacagtgctgtgtattccggctgaatttttctagagcgccttcttaacccggcgtgcattgtggccaaatcttctattatgtccgatataccggaggatgccgaccctgggatcaaagttttgtttgccgttgatggttgcgccgtctcgttctcccttgcacttcttacgggtcaggtcccatctatcaatcccgtctacgttatcagccactgggatccgggcaatcgtttgttagatgtcctttgccaccgcgcagacgatcgcgactgcggaagaataccgaatgaacgaggagatttaaacgcggtctccgaccctctaaaagtagagttttgccttctcagtcaaatgacacgcggtttgggcggcgccgatttaaaattgcggacgcgagcgatattcgtgtgccggtttacttcgcattccgagattaactccatcgtggcttctatagcttccggagcgcctattcaaacagacttattaatagccaccctctccgaatatgacacatttcgcctacatgatgacttcaacatcgccctccacatctctctcgcctgtttatcgcaaaagcgccgcaatgggaaagagccggcaaaatcaccggatcgaaatctgctatcgattatggcgggaaccttttctggaggtcggcgcggtctagccgggctgtatttacaatacgagcaaaaagtcaccgcggcctaccgacgtgtatatggggggtcgacgacgacagcgttctggtacgtgtctaaatttggaccggaagaaaagagcctggtcttggcgctacgttattaccttttgcaagctcaggccgaacctactgggattgctacgggttacgatttacaggccataaaagatatctgcgacacgtacgctgtacccgtagaggccaatcctaccgggttttcgacggcagacttgacatcgtttgccagattatcgcgtttctgttgcgtgagcaattatgccaacggtcccgtagctagggcgtttcccctatacgtggaacacagaattgcagccgacgtgacagaagtggatgcattgaaagagtatatagaaagagaccggtccgggttaaagatttcggatttggaatttgtcaaatatatttacttggcttacttcgagtgctacaatcgtgctcaattaagacgtcatttgcgagacgtgaccgtgcgttgtcccgaagaagatgtctacaaacgctcgtctctggggaaacacgcagtcgataatttctttacgcatgtgagatccagactaaacgtgaacgatcacatagcatgtaacgtatctccggatcaagtggaaatgggaaacgttttgacccgagcattttgtagggccaggacctatccaccgagtaccatggaaagcgatgcgcgtttcaccgggatttgcgaaccctcgtcggtgattataaagcgtctggatgccctagaatcgacattacacaaatacggatggccgcgcgcacggtctgaaacagttaacatgatgtcagagtgcgcgaatttgcccatcgcttcatctgccgatagtcttaggccacccggcctgccgctagaacatccaggcactcattgccggggtggtccaatgatcgtaaagcgcctactagcgctagtatccgcagatgcacgtgtcggggacataggaccgacaaacatgctcaccggcattcgggaatcggccgtcaagggccctcttccgatttaccggataggcatgtccaaaggcaaacaagcgtttgccgtgatggtggccgattgttgggacaaaatcatcccgtctccgggaattgtgaaagcccatctctctaaactcggcagatccggtagagcccccgaagacgatgtgatcgcccgagatattttttttacatcagaacttgagcgagtcacgggccatgctgcggaactgccgtactttacctgcggccctgccgaagaacaacagtacataaatcgcaacgaagtgttcaatgacaatcttattgtggggaacataatcctggatgtcgatgtgcacttacgaacccccgtacccgtcaaacttttgcatgtggcaatgagaggttttaggaccggtgcgctcaaagcgttgtctctattacttccaaaagcaaaaatagatcacggctcgtacccgtgctacttttacaaaacctcgtgcaagaaatctcgagtcgtgcacgtaaaacattggatgtcgtctactaccgacttcgctctcgactgcgacggtcccgccgtcgaaagtgcagactgcgaactagaaatgggcttcgatgacccgttacttatggatcaaattgatgattccatcagtagatgtgagtcagatgcatcaagtttgccgtcggacgccgatctgccttgtaactgtcacgaaaaaataggattgcgggtctgcattccggtgccgcccccgtatctactcgtaggtagcagaacaatgagcggtctggctagggtactgcaacaatcggttctgttagaacgtagtttcgtagaacctatcggttcgtatctcaaaaactatgatatagttgatagcggagtatatggtcacggtcgcagcttgcggcttcctttttttggcaagatagacgagaccgggcttatatcaggccgcctgcttccgttttgcgtgataccggagcgctgcggtgacgcagaacagttcgttctgtctcatttacagcctaaaacctttcacttccacagtcccatgcccgaagaagatcacgcgtctgtagttctgaagggcctaggcggagagtatgccggattctttgaaaaaaaaatcacgatcaatagagatacgtttttcggaatcagattatccttagcggtagctctgaaagccaggggggttgacattaacgactctgcggcaatcgtatcattcgtaacggagcacattttagatgacataattcagtacatgcatgaccacatacccgatcacgctgcggaatataatcacgtttctgtttcgtgctgcgtcattagaccagattggatcctcttgcagctaatggccaataaaacattgggacgcgctcacgggtttacgtgcgtgaggtttaagcatacaagaacgactcgaatgagttcgcgttcgtatttgtctttaaacatcgacgcacatggtaggttgtgcgcgtgtgtgattcagcagtgttttgcggccaagtgtggaaacaataaactccgtactctttttacggtggatgtcgattcgaaatgccaggcagaacatcgatagccctttcgggaattatactctgcatctcgacatacgccatcgctttggtgatctacacgacgatgatagctaaacacggttctgggtgcatctatgccgtcctggtagacagcgatcatcgcgatgccaaaaattttacatgggagccatacaattctacactggtatacacgccgctggggaataaattaccattggacggaggatttggcggttttagcgatgtatgtaacacatatctgatcaacgcgacggatttattcggacgcgcgtctcacgcgtccgccaagtcgaaaatccgttcggtggtaggaacgcgcaattgcgcagcctacttttggaagacgcatatacaagccttgaccttttccctaagttcgtacattatgttttgcgtcattagagaatggagacgcatgtttggggtggtgcgatctgaaaacgacagaataccgccgacgacgtacacgaagaattatactgccagggtaatcgctaacggattgctaaaaacggtatatactagaatgtctgaatttatgtgcgagattactatatacaaaaattctatgtgcagaatatttacagacgaccctatctcgtttatcttacgtcaccctttggctgcgattctccttataaccgagcggctcataaggctcggcgcacagtgtctgtgtgtactaacggtatcgattttttttgtaccgtgtaaaatagttttatcgaaatggttcttgtctatcaccggagttttcttaggaatcgttatttgcaccgagatgggcctgctgatagacccgggaccggctgaaaaacctgtcatgtttgcagaagttgccccagcccccaaaacccagcagaacggcgtggctgtcccgttcggtgcacacgctgtatgttccaattgctgcgcctccataatctccagcatagtcatcaaagttctgtacgtgttattcatggttaccctcatcgttaccctcgtgcgatatgaacgagcgctccagattgccctgttcgggcgtgcgtacctaccctaaaacattagtggccaagcctcctatttgcatcgcgcggatgtgacacgctaaccgcgagaccttataaatggttccaatgagtcattcgcccctcgggtgtacgcggtattctacagcagcgtattagataaactacacgggtttgccgtcgcgcctcaaggaaaatgtcagtgggagctttctctcgtgattgggacgatataatgagtttgtcagactacgattttacagaggaagaatccttagatgaaagcggcgaactgaaagaattcaagaacacgtccgcgttgaatgctattgagacagcccgcgacgcaattgaaagatcagccaattcaaacccccccatcgaagaaccgtcgttcatctccaaatctcatgcaggcgagacctcggcctcgaaatatagaagcttgcccctcgacatcgaaaaggcagaacggtgtgatgacactcgaggctacaacgtgagttcgggaaaacgaatgcgtttggcagtttcggccactgttgacctgtgcgagtctgagatcgaacggcaatgtctgaatacggaaacgcgggaccgtgcacggtcccccaaacattttgcatcccattatgaaatcgccgccaaaatacacgatcttcccagatctacgggaaaaaggcaacggcatcgcacgttagattctcgctcacgacgccacttagcgggagagcatcggcggcggggagctcatgacgaggaaagcagacacttttccctcagaatgcgtgaccctcattcagcacccggcaagagcccgctgtcgaaaaggcgcagtcccgttaggctccgtaacctctctgtgcaggaggaacttaacgcgatgctacaacgagagaaactgaagctcgacatgatttcgagagagcgcaatttccgcacttctagcaaaaaccgctgggcctcagtactggcattctcctgtaccggaaaaagtggggcatacgggtctcagataacgtggcaatatttgcttcaagagggaccggagcttagaaagacgttcgaaaatagacctagaacctcattgctggcgtctgcggcgcgcgaagctgtgttgcggggcgaaaacttagttgcggcattggagagcgccgaggaaaccctggcatggctgaaattacactctgttctaaaactgcgtttaatgaaccatgaccctattttcaggacggcgggtgccgtcttagataatctcaagctgaaactcgcacccataatgatgtgtagaaatggtacagacaaacggtcgttaggagacatgctgagaagatccgccacggacgatatcgccgattcattgaccttatgcttaattttgctatcgcgtattcatcgcatgatgatgtatcgcgtgtcgggtagaaaagatagttccatgatagatcctcggggatacatgagagagtatactcctggtgaatgtatggcgggtatattgcattacgtagacgcgcatgcaaaaacgtgttccgacagagcgtgcaatttatatattagctgtacccttatgcctgtttacgtacacggcaggtactttcgatgcaattccgcgtttgatatgtaacctactacagacgggcaattttgtattcttcaatagctttatttgatatccattaaacttaaataaagacaccgatattcaattggacatgaacagcgtgcgttttattttacacttagcctgtgtgctttcgacaccgagtaggaaaacgaaggacctgaaattgcacgcacgaccgaaggaaataagccatcgcaatcgcatttgaaatccaagtaggcaaattcaggagaacctatcacttcattgaacaagttctcgagtattcttatgaatgataagcactggagcccgccagggcgatcgcagacacaactaattaacatgccgtgagtgctgaagttctctctcatggcagattcgcataagtaaatagtcttccttcgagttcctatctccgtgaatctgcgggggttcatcagaagcgcaggtttgatttccgacgtgtgattagaatgaaattgtcgaaagacagtctttagagtcattggcatgtctgtcagtactatggacacttccttgcggcagcgatcggtaaggaaccacagtagttccttaggtagtatgtttctacctaggaaccacggtgttcccacggccaaaaaccaagcgtggtcaaacgatccggtgctcggagaagaacgctgcgtatccgctacccaaagcagtatcctttcgcagatagacgacgttgccgtgaccattctccctttccaacctcccgtcagtacactgtttattgggcccccggcgtgcgtgaggagtaccggtctagcgactattccataaacgttagtcggtgagagttctctcggggtgagccacattgggaagcccgtctgggttggagcgtccgatgtagagtcgtaattggcgcagcgctgaccctgcggtctacaatgcatggtcatgctagacgggacaactagtcgcccggtgcatttttcattacggccatcccttacgtccacgtaccacgtgccgtgagtgtgtaggtaacacgtagtgggcgtggaaaaacttatataacacccggcagaaaccacgtgcgcccagcggtggcagatcctcagttctacagtgtccaatggcggaaagtacagctgaaccgtcagcttcaccggtacgaattccgtacgtttggcaagtgatcgctccgttagcaattgacgtgccgtccgcctctactcaactagctacgggcgaacatgtgtcatgtgccgcatccgttattcctcgttcgtacgtcatacgggcagcgtgtaaatcgtcgacgactttccacgcgttcttctttggattggcgacggatccgtctgagaacatgtcccaatgcggtgcctcgtatatcgcgtatagaatgaacaagaagttacggactggtcgattgacaggcgaccaatgcgagtcgcctttttctcatgcgacgatcatcgactcactggatgaaaactacagcatggctatagagggactgtgttttcattgccactgcgaaaataagttttcgctcgagtgttggagatcggcttttagcgctgccgaaaaaatcgcatcgcagtgcagagctattcgcgagtacggacactgaataaaaacgaatcatgatttgatctaccatttcagcatttattggtttatacattctcgggttcgtatgtatacaaaatcttatggcaacccgcgataacaattcatttacgcataccaattgcgagagctaggggcgcaccctcaggttcgcctacgccggtatagcgttgagatctaatacgggagtagtgattttgcaggaatgtaagtggtagtaacacctaaagaaaaccacatactaacgctctactgttcactcgtatctacgtgcagtgaggttcccgcatatgtttgcgcgtcatcaatcgctctcgccagtatcgccacaatgcgtttttcgcgcgcgggtattgggacgcagtgtaagtggaatagcattccgcaggcaaaaaagttgtttgtcatgcaagcatccatcaagtagcaatcacatagtgggaccagacgcctcaaagcgacgtagtggggggaaccctcttcccattgcaaccactttcgaaatctgtaggtatatgctgccagccagcgccttgttctgacggttattaccctgaaccccttaaatgggaagaagaatccaaggtaccaatcgttggcgactggcccgtgcggacaacgggttaaggatgtgacaaactgtgtttgcgtgggtacgtttacgatgtatttcgaatcccgcacgacgcattcctcccagtgagatagtagtatcccataattcatgcatctgactaccttgggggtgagacacgctgtaatatgaggcgtcgcttgtaaaacgcacctgtatggaaccgttccgagttcggggattgattctatgatagcaagtctacttattccggaaaccgccatgacatcgcacaaaggaagcagttggttaattgcatgaatcagaatgtttgtttccagcacggcacctccaaaggaaaataatgtttcgatgcacgttcgtgccccgttctctgtattacagcttactagcgcaaggctgaggacaaaaacgagttcgggctttgtatgttcgagcggaacaccaatgcgacataccgtatcgcttaagtttttcataaaagtggatcttgcacgtttgccagatctgctccaatcggccgaaaaaaatttgcgcacaatcggatgcatgtctgtgcctacaaataccatgaaacataattcttgtgctggacccccatccccgctatctatatctacattgtctgacatgtgttgtgccgacaacaaacggtgtcttgtatccccatcaatccagcgctttctgaggtttacgggctttaggatggacacatcaccgcatttcggcacgcataacgcgggcatgtctgaacgggcaacgattctctctgtgagcagatcgagacggccgtgacgcacaccacgtgccggtacattaggcacgactgtagcaaaaggatggtagcgatggagccagcctaccgacagtcccgcaaaaaatcttatcggcggaatgtctcttttaaggggtagtgtgttacgaaccgatgaattcaatttctctgtccaaccacttatcgcttccgcaacagaaaaatcgtttctaagttgcgaatatgtttctaccacccacttgagatcgctgcgaagggcttccgacatttttttagcgtattcctcatctccatcacaatcacagtcgtgtctttcatttgcaagtgtgggcgcgcagatgtctacgcgacgacttaaccgagacactgtttctctagtgtaccggtaacatggactggcgcccgctctgaccgttagcatgcgtttggatgcaaccgaggttagataaacgtctggagaactgcccaattctttgctttcactggcacatatccaaccgtatgtatcctctgtctgtcctgccgcctcaaagttaccggggagaggtccgggactcgctagacagaagtcgatttgggaaaattctgtgtcattgttgtagggactgtgcggcctatctaccatagttgcagaatcgtgcattagaatttcagcgagcatggaatcgatacgttcgtcggcacccgcatatacggcacctattcctattcgcgtacaagagtcatcttctacatcaagcttccagaacgttgtcaggtattcgccataggctgcaaagtctgcatctgtggttcttcttacaaattcaatctccgggttccaacgtccacgtcccatacataggttgcgcaacgtgatcgagtacgccaacgtattgaaatcatttatgctagatgcttcgctattatcttcgaacaaaattatcgtatacaatttcgattgatgcatcgatcgaaggactgacaaatctgtcgcatatgtctcctcggggagaggtgtgacggtgataggctcgtccctacgttcgaaccggataaggcctactgtagcggtggtttcagtagtcctgatgcatcgtaaaattgtggcctcggttctaattttcccgagtaaggcccacggaggtccgcaattactattacacagggcctggattacggaggaagtgccagttggtgcacaccgaaactctggaaaccattccttggacggaataggagggtggaatttttgtcgtttagtccactccatctgttcgtacatggaaaatcgtgttaattcctgatcgtcgaaatgtgctaatggagctatagtgctgcgttcggctggtgcggaacctatagacacgacatattttggttgcacgtgcagttctctgagctgattaggaaataatactgcgtttgatgatagcaaagacctttcgggatcgagctccggagtgcagtgcgaagcgtgaacaattctacttttcttccgagacggtgtgaagcaaaacatcttgacgatgctacgttctatggcattctgcaacaataaagtatcaaattattttgacattatcatctatagtatgagcggtgtgttatataagaggacgaaacacttgtgaagtagacacgttttattcaggaactcacattttcactactacgctgttgtgagcagagagataagcgcggcggaaaaaacagtcacaaatactactgttaatataatgatcgcagccgcatcctgtcgggcattaaacaaccaatcctcttcatcattagtttccgaagagctagtctcataaggcggcggaggagagtcgtaggtaggaggtggtccatttgaggcttcatacggaggcaaatatgcagcgtcgcattgaccgtcccccagttgtaattcgaaatgttcatataccgattccccgggagcgtctaaaaatggttgctcctcatgtaacgcttgcgcttcgctcgtcagaccgcggtctagctctgcgctcgtaagttcggtttgcggtcggtcgctatccattttccctcgcccgcagtaactgtgtcgatggttcactactctcgaaggagttaaattgcctactttctcctcgaatctcgaatgtggctatgcagcatcagggtcattagcgtcagtattttcctctttggagtctatggctctaccccaaatacctcccgcgattgctcctgtgcataaggccataaacaggccggccctctgccaacccgttgaatccaccttcactgctctgccaattagtattcctgcaaaaaatgccatgcatgatcccattactaatgatcttgcggaccgaataagcgtgattaccattaaggagcgcattgtagcattctcagattccacagataaaacagtacgaggtactgtaggagcaaggcgctgacctacgaggttttgttgcacctttcccgctcctttttctgctatcatcagtaagttaatggactgcacgatttcgctttcggcccggaggaggcggcgggcatcttgtaccgcgcgctcggcgcgccggagcaggcgcgcgtgcgcctcgtccgcgtccgcgcccgcgtccgcgcccgggtcgtcgcccgggtcgtcgcccgggtcggcgcccgggtcgtcgcccgcgcccgcgcccgcgtcgtcgcccgggtcgtcgcccgggtcgtcgcccgggtccgcgcccggtccgcgccctccggcgtcgttctctccggcgtccgggtcgccccctccgtccccggctccgctctcgcgctccgcatccctctcggcgtccggaggggcgcgcggatcagcggtcgggtcgcgatcgcgtccgtcggatcggcgccttttcccccgccgcatcgcgttccgccgggccggtcggacgggagaagaagggggagggggggaaggaggagaggggggagggagggtagccggccggcctgcagttcgggaagagcgggggaggcgccgtccgaggccgccggggaggaggttgtggggggcgggaggatgtgtgggggaagggaagggggagacggccgaaacctacgcgttcgccgcggcgtccgatccgggatcgctcccgacggggctctcgttcggcgatcgcttatcctctgccgccaccttgcgtccgttcgcgggaagcgccggaccggcgctctaagcggagatccggcgcctccgcttcttatgaccgggccggtcgtgagggcgtaacgatcacgtgatgcaatgcaaacgagcggggcgaacgcgtcagcgttcgcaccgcgaaccaatataagattatatatataatatattattggcgcaaggtgcgaacgcccgtccgggccaatcgggaagcgggatcctatgccacgtgttcgtgtccggccgcggcccgcgccgggggctagaaacgccgcccccctcccacgggggcggattcggggacctccggcctacaaatacgcgagcggaggtccggcggggaccgtcgttccgctggccggcccgccgtccgaaagcgcgggaccgcggtaataaagcgcccgccgtcgcggatcggattttctggtcgttcttttaccgccgggcgaaccgcgcggcgaacgaacccgtcccgttgggatcgcaggcggccgggaagcgatcgcgcgccgtcccgagaacgtcgtctacggctcgcgttcgcgggggtcgccgacgggtggaagggggatgggtaccgagggcatcgaactggccgagctcggcatctccgccttcgggccgcgaccctcgcggcgtccggaaccgtcggacgtcgagggaggacgccccatcgttctcgtccgcggatcgtcccgatccctcgcacgagaacgagatccgaccccgcgtcggcgacgcggccgaacgccgctcgcggaacacggtcgcgggtcgccccccgactttccccccggccccgcacccgcggcgaggtcggaacctcgggaatcgattgaaaacgggccggtcgagataggaccgctctctcgttcggaagcggagcaataaagccgttcggcgtgagctcgggatgagtctcggacgcgcgtcggtccgtttctgcccttgcggcgctctacgaaagaacccgatgaggccgcgttctgttcgggagcggtcccgagctgtagggatcggctcagtagtaactcgtctcgggtttcgatcgagttctagcgaaccccgaaaggggggtacgaggaagcttgcggcctgccgcaaaaagactccgaggagaatagcttatccgcgatacgccgccccctcaaccgttcagcactcacttcggcgtcagttccgaagtgactttgtctggccggctcggcgcgagccggcctcggagagaacgcgtacatagcgatcgtgggctgggcaacgagataggagtagagggatggggaaaaagtgaagtcccgcgctggctctggacgaggcggaacgaaatgggggaggggacggcctctcgaacgagagcgggggtggggcatggtcggtggaggggtgtgggaaacgccgcgacgccgcggcccgtccatgtggtaatgcggggaatagagttccctgacggggaggagttgtcagctcaccggtcccgtgatcaacgcatatgccacatatatgcaaccccgcgaccctctcctcacgaacagggtagagggtctcgctttgttgcacacacaagcacactcacttttgcggcgacaatgaaaatcgtgagcccagaccaattgcccctatatgtgttaacggcctccgacggaacaacggagttcagtattcgagattggtcgctatgggatcgggatccggaatcccgtgcaggtacgcaccgcgggctccgtcaaacggaacgctctcttttggagcgatgtcgtttgggtccgggcccgagtagggttcggccggctatttccctcccccccccccccccaagcccgtgcgggaccgaggttgagtgggaaggtctcgcctgccggatcgggggggaggggaaaagacgtttgcgttatccggaatcgagccggaccgttttacgtttcagagttcgaacacgctctcacgagctgcagccaccggctcaagccctcagaccgcgtccgcgccccgggccagcctagcgtcgcaaacgtctggaagagtctgtggagtttggtttcgagggccgtgcggggaaacgcagagggctcctacggacgaccggaggagggagacgccgaaactgccgtgtaaacgaatgcttagcggagccgcgcccgggacgcgtcgtttcttgcgaaacggggtggatcgctcgcccgctcttagccctcgcgtacagtgcgtcgatcgttaaggtgtacgtgcgtgtacgagaccgcgtgcgagcggtctcgtcgtagtgcgtatgaacgtgtttattaaaaagtctttctcgcttcggtcccgtttcggtgtctggcgatggcgcgggcgggggagtccgtcgcgtaagtcggggaacgtactttgtcctctcctctcccccgaggcgggatgtgcgagggggggggcgacgggcgaccgggaatgcgtgcgattagtgttgtggagaacgtaccgcgccgaggcccgcggtgcgcgcgaagggttagttgggggaggggcacgcgcatcataagtcgctcgcggatcgtccaggtgtttgtgcgggggatacagtttcgcgacggggaggagccgttagctcaccggccccgcgggagacgcagatgcgatataaacagccccgcggtccacctccttgttcgcgacctgctacttagcctcgcttcgttcccacgtataagcaccactgacttacgcggcgaccgtggaagtcgcgagttccgaccagtgtcgcgtatatgtgttaacggcccccgtcggaaccgaattccacattcgagatgaagtgctacggaatcaggaatcccgtcccggccgcgcgcacacccacacacacccccacacacacccccacacacccccacacacaccgcggctacagagcggctgtcgtagtacgtataggcgcgagcgcgaacacttgcacggactctcgtcgtagcacgttcaaatcggtttattaaagccctcatgctcagactccgtgtcgatggcgggggggggggggtggtgagtgacacgaacttactttcctgcgacgctcccgagaggaggtgtgcaccgggccgttttctccgagactgaaaagagaaagaaaagctccgccgttcgcccggccgagcgcccggacgcaccggtgtccgtacggccttcggacgcttagagagcgcgggcgtttcgcgccgctgcggcgtttaggcgcgcagcggcgcgtttgcaaaaaaaaagaatgtacggagagacccgcccgccagcctctccggcccggagcggaaacgccgcgttatctctacgcccccgacccgcacatccgaatgcgcggtcggatcgcgaggttaactccctgcccgcgcccgcgctccgcgctccccctgcgttgtttaccggttcgcgatcgcgatcgcggaagtcgcagggccgacttccttgtttacattgaatacgtcgacggaagcgcaactgcgtatgtccgccgcgcagacgcagaagcgccggggccgaatccgggaagaagagtaatacggggcttctccagcgcgtaagtaccggcgttccgggcggtcggcgagtcggcggagaaaaggtggatcgcgagcgcgatccgaatccgcgggccgaggggaaattcttcctatcccctgtgcgttgagcgccccgtgccgtgccgcctttttccgtttccggtcggactcggagccttcccgccgcacggttcggactcccccccccccccgcaacggttttattttcccgcgttcgaccccggcgtgatgtccgcttttctgttaaaccgtgcgttcgtcttatagggaagccatcttaattctgacatgcgcgaatgcgtctttcccccttccaaggcctaaccccccccgcgctttctcgtttccgccgtgggccatttatcttcccccccgcgtaaacaattatccctcccccgcgcgtcctacttttcttctgagacctatcgcctttggcgattctagtcagattgccttttatagtcaagtttcgagcagatcctaagcaagcatgccctgtaccccaccccccttctaaataaatttccgatccctggaggtttccggagtatttgtcccaggagcggggtcctatgcagtaatcgtaggtctttcatgtatgggggggggggagggggggggagatgcgaacgcccacactggtgttggttcgtccgccacggaagctggaaccccatcggacgtctcggcgccctgtttgcaaaatgtcaggtacttgtagtgcattccacgtaggaaaatggtcgtgaggggagggggggctgagtttttctgttatgggtatcctgaggggtctacgtgaaagtgactggccttccgttttcccacagaaacgttgtgtggtacggtgcaccctgagagatgatctatattctcaggaagttccgtgcccgaaacgctctgaacgataagcttctagattgcatcggggattcctctgagaagagcgggtggggaaatacatagccgttaaagtctcgcggtccgatatccccgtttggccggtggatgagtcgcgatggccggacggggccggaaatgcgatccttcttttgcgggctatttgcgatggaagggaaaggcaaaccggaaaacttaaggccgtttggtgtgtttttcccttccatcgcaggtcgtgccgcagtacttttgaatcggagggagacgtcgggcgagtgggaatgggcatcgcggggtcatcctttattctgggacgaccgcgaatctacgtgtcgtctcagtctggacggcccatggaaaaaaaaaagagtcgagaggcgtggggggggggggaggcctgaacggccggcgcgataagggatacgtggtcaatcttggcgattaagcctagatattgcgcggggagtggggcggcggtccaatgcctagaagggcattattcgaaatttggagtcgggctgcgtagcgacgggtggcgcgcattaatacccctatcttttttttttttgcttcgtttcttgtggccggcttgggaaatgtcagcggaaaacatgcacccgctgtgtgaatgtaaaccgcgtaagtaaacccgtgttagactagatttcgcaagttgcgaaggggggcgattggggaggaggaagtctgaacggaggggggagaagggaggggggagggggaaggctgaacggaggggggagaagggaggggggagggggaaggctgaacggaggtgggagaagggggaagaagggagggagtggggaggggggggggagaagaggggaagggggaaggggggaagggagggggggaagggagggggggaagggagggggggaagggagggggggaagggagggggggaagggagggggaagggaggaagaggggagggggggggaagggaggaagaagggaggggggaagaagggaggggggaagaagggaggggggaagaagggaggggggaagaagggaggggggaagaagggaggggggaagaagggaggggggaagaagggaggggggaagaagggaggggggagaagggagggggggagaagggaggggggaagaagggaggggggagaaggggccctggcgagatcggctctgaattcttcgttgtagatagcagacgaccgtaaacctgaagtacctgtgacttggacggtgatgagatgtttggcctagttacagggactggcctttgttagacacgatggcctttggaaacgcatccagtctgttttggcatctgagtggcgcgtagccgttgtcagatgccagagagactgaaatgtttctcgaggactctaaccgtaatctgaataggcccggaccttaatcccaataggccgtgccgggatatcagaggagagccgctcggaccgctgcgattccatccttcgactagcgacttgttatggcgggtaatagccggacgacggagtctcggcggttcgaccttagcgggccccggataggtttctcggttggggacaaaggggaggtagaggcgtcggatgcggggcgatgagcgggtatttaggccacgagatcaggtgttgtgaggaaggggtaacgacgccgtattgcggtcggaccgcacgacggcgcgtcgtccagtccttcccgggtcccctagaggtgtcacgttctaggacaaccgggacggacagggcgacgcgcgcgaaatgcctcgtatcgcctgatatgctcggaacgagtcggggaagggcgcgaaagcgagagttactactcggaactcgggactgttcgtatgttttctctcaggctggcattgcacgtgtcattgccgttgtgcaatgcctgcggagagaaagacgaattgattccccgtgccgctccccgtcgtgtgggacaaggttgggagggctctgggcgaagaaccggctgagcatcggcgcgcgcgccgtgtcccccctcggcggtgtgcacgggagtatcgggcgccgtcctcatgcccccctccgagggtagcacgcggtggtcgctgcggtcttttcaaaacaggttctgcgaagcagagatgcgtcggcgcgcgagcgaagcgaaccgagctctgctccgtccttagcgtggtgcctgagattttaacacgtatcgtctcaagtactgcgcgcaaggaccgaggcggcgttccaaacgtcggacgggacggcgcggcgtcgtcgcgcgccgcggaaatcgttacacgctccgcttcctccttcgcggggtgcttgagatcaccgaatgacgggatcgagcaccacgccgatggacggagatggcgcgcggtacgttcactgaatcgcaacgaggccgggccgcgctgcagggatggccgcgggtacgcgcgccgagtatgggggggcgcgtgctctcctacggccgactcttgggagcgtgcatcgttcgggggtcggctgttgggtaagacgtggtctctttcaggtcggtgctgttattttcggcggggcgcgggacttcgtcctgggccgtcttacacgcacgtcactctggtcgtatcggtagtcctagtggcttgcttgtaggctgtccgtcggaggaagacagcaccgccgcccagctgcctgtgcgagcgcaggactcgtgtccacgtcctgcgtgactgttcgcccgccgttcggatggtccgtggtacggtgtcctgtgttgtgtgagaggtctccgtacaccggaccatcgaaggggggtgggggggatatgcgaccgcagagcgacttttaggctgccgctgtgcagtgttcggttgggtggggagggaggaatgtctgtaaatcttacggcgatatgctggatcgtgagaggtgagtacgtgtctgtgcgggtaggtgggagcataaccacaaaaagactagaattctgcccgcggggaaatggcggtgtgtgtaatgcttctgttccaaacgaaggtgcggaataggagcgaaatggaccgaccttcccccgcgacgacgtaagtggcttgttacgacctgggaggcctagctgtgttctcgctcgttgccagtggataggctcgcccttttttgtaacagatggcgatggaacagaggttcctatgtgggggggggggggcgggaaggataacgtctatcgatcccgaagtcttcgttgcggatatgagacgatcagtactctcaccgatctgcatatcggacgcggaggggcgagagagggcccgtggttaggcgtctgtactccgaactgcttccattttttcccttacggtgcctgacgtcgtattttaacggttagatgccgtcagggaaagatgggagtttgtttgctcgagccctgccggcggactgcaggcgaagaagtagccgggcgcgaagcggctgggaatcgggtcgcgtggcgtgtcctccttcggacgagtgcttgccggggagtaaccgtcatgcactactccgggggtaggacgcgacgtgcgacgcgctctccggatcggtgccgtgctgcctgagatcgagagcatcggacggagcccagcgccgtcctttgtgctgtgtgtgagaggtcgtcatcccttctcgggcaccgcaccgaaggatggagtgggccctcgaaacgtcatccggaacgccgcgggacgaagccgccccggtaaagtccagacgcgcgcagttccctccttcgtccggtgttcgaggcgtgagacttttgtattgccgcgtcgagcaccgtgctggaggaaggagatggcgctctactccgggacgaaggcgctgcggagcgcatcgcgtggtgttagaggtggatcctgtcatcaagcaccacgtcgatggacggagactgggcgcgaagcgttctgcgggatcgcgtggaacgagggcgcaccctcggtcgcgattttctcgacgcctaccctcggcgttgttcgtcggccgagggtaggcgcagaggaaatcgcggtcgctgtggactccggtgtctggtatcatgtccggctcgagtcgtacgtcctgaaatgttgcttctgattccgacgggtcttcttcacgtacctctctatggctgcatctttatggccatagtgaggtacgtgtaggctacctgccggagaaaggcggtcccgacgaatacgcgtcccgtgtagcggtcgcccgctctgcgatgggctggttccggcatcaatattgcagggtctatttttgtggtgggcgtgaccgcgcatcgcatcgaaataaatctttaaaccggccgagttcattgttgggctatgctcggttttcggggggggggtgtggaaggagggtactaggttagggttagggtcgggcccttagggtcatggtcagggttaggcctttaaggtcatgcttaggtctttaggggcagggtcgggcctttagggtgatggttgggcccttaggggcaggggctcggggtaagggttagtgccagggtcgggtgtcagggtcatggacagggatatgccgttaaggttagggttggggtccaaagttaggcgtttaggggtcgggtcgggttcggggttaggcctttaggggttgtgtctggtttagggttaggcctttaggggcagtctcggggtcgtggttaggcgtttaggggtcgggtcgagttcggggttagacctttaggggtagtgtcgggtttagggttaggcctttaggggtagtgtcgttgtcggggttaggcctgtaggggtagtgtcgttgtcggggttaggcctttaggggtagtgtcggggtcggggttaggcctttaggggcaagctcaggtgcagggtcggggttaggcctttaggggcagggttagggtcagggtcggggttaggcttctggatcgggtctttagggtcggggttaggcttctggatcgggtctttagggtcggggtgattatgatcagagactaagagcgcgaaggcctatcagtgttaggttctctgggtcagggttaaggcctcggggttagggtctcaagggcggcgtttggcttaggggcccggggttaggacctgtcaaggtcagggttatggcctatcagagttcgtggtcacaggtgtaagggttattagggcctattaatgtcaggccctattcgggttaggctcccaccgagtactaaggttagggtcttgtaagggttggggcccgtaagggtaggggctggggtctgttacgggcagggccccccccacacggttcgacctgccacgcttaggttcccatcccccctcccccccccgagtagggttagggcctggcaggggtagggtaggcgcgaaggttgggcccgttagggctaggagcgaccctcctccccccccccattattgttagtctgttaaggaggcgttccccctccccgtcagggttagggcctgttaggggtagggtaacagggttaggttaggggttaaggtctctcggaattagggcggggcgtgtaatggttatagggtcagggcgtgccgcggattgagggtcggggccggcgagggtgtcgttccggtgtttacggaaacggcggatgtgcgcgcatgcgctcgcgcgcgagccagacggacggacggacggacgcgtctcgtagcagcattccatgggcgtttttattcgtactggccgacggcttcagcccgggtcggggctaggagcgcccgcgtgcgcgatgaagccgccgtctcccggcggcgacgcaaaggctgcggtccgcggttcccaagcgtcctgcgtccccgccattgctgcaccgctgccggaaaaagaaaaacatcctgtacgcacttcccgagcgccgggacagaggcggtctccgccagccccccgcgaaattccaaaaagccggtgtggcggactcggccatggaatctacggggggggggttgagggggggatgcggcgctgtagtcgccggatgcagtcaggacacggaaattaagcgcgtccggacgtgccggacaatcgcgtacgcggaagtgcttgcacgggaagtaaacagtggaccgcggcttaccttcccagcaggagtacggtgttcgcggagaaaactgtaaggcgggagcccatcgtcgtgcgctcccggtcctctcggaatcggctgcgagtctcaaaaaaacaggaaaggggatcggcctcacaaaaccacttcctcattcgtgactgcgcgtagcctccgttcttgaaagcggttggcgttcgcacagacctgagtcgacaccgcctacctgttgtttactttcaatgtagtgcgttgcacagagacgctcggggccgggtacaagttgcccgggtccgcgggtctgaagcacgcactcttccgttgaaggacggggtgggaaagcggattattggaccccgcgatagggtctgttagggtcgggggttcggcctgtcatcacggtcggggttagggcctgtcttattcgttttagtgcctgttagggccacattaagggcttgggccagggccgtttacggtggcggttagggcctctcggggtcggcgtcaggactgttagggtcactgttatggcctttcagggttagggtaatagtccatagtcggggtcaggacatattaagggtagcggctttggcggttacggcatgtagggctaggaccttttaatgtaacgggcagcgttggtgtcatgtatcacggtcggggtgactgttaggcctcgccgggcctcatttcacggtcggggctatggcagggtcagagtctgtggtggtgtgcttcggtcacccactgtgtccgcgcaatgctgcgcgttcattctgcctgtagccgacagttcgcggggtgcggcagcccgcgggctgagtgcacctgtggcggcgggaggctgcggcccagccgcgttaattgttgtgctatgttccttttttggggggggggtgaaatgcagggggggatattaagttggttagggttagggttagggttagggttagggttagggttagggttagggttagggttagggttagggttagggttagggttagggttaggccgttagggttagggttaggcctttagggttagggttaggcctttagggttagggttagggtgaattttttttattcagttcgccgccgcgagagttttggtatgacgtttggtggtggccagggtccgccgcgcgcatgctccctacggtccgccgcgcgcatgctccctacggtccgccgcgcgcatgctcgctagggtccgccgcgcgcatgctcgcaaatgtcgactgcgcgcatgcgcgcacgggtccgctacgcatttccgggcggcctagcgagcgcccgcgcggccggcgggcatgtccggcggggatgcagcgtgcggctcggcctactggccgcgcggagccgccggcggtcggcggtctaacgcttggagtcgcgccccccccccccccccgatcagacgcaaggctttttcaggcgcccgtctcggtcacttaggacagccgcggttcgtctcgaaaaaggtctgcggcgtgggtggtgggggaaagggggaggggcagaacagtccagagaccgtcacgggcgaacgattggggtccgcggggggcgcgaggtggactcggtagccgccgcggtccgatccggaaaccgtgtcccccctgcgctttcttcgggcccgctcgccgacgcgaatggggtgggggaggggggtgcgcgggcgaacaattagggaccgcggagtgcgacagcgggcctcggtagccgccgcggtccgatccggaaaccctgtcccgctgccgctttcctcgggcccgctcgccgactcgatcagaaacccgtctcccccgccatttttatgtctcccgtatgcgcgctcgttcccgccactttctggtgccgctgcggaagaggatagccgggcgggcgagcgggcgagcgcgccgcggaccgaaccgctccgcgggctgcgcaggggaccgcagagattgctcccgcgcgagggatcgatccgcggggtagagggctctccgcgaacagcgtaagaacagaggtgtccccgcgcgccgctgcctccggacgcaccccccgcccccccccccccggccacccagggcgaccgaaaccccctgccgccgccggcaagagtcggtcagagagcgcgaatgatgtctgtcgcatctggtcccttcattcattcattcattcattcattcattcattcattcatttatttatttatttattcgccagcgctacatctcaatcccagctaccgttaaccctaccaccacccccccccccccccccgaccttgagcggttctatccgttcgagatgaccttcacggagcggagctcgttgcaggatccggaggagcggtttccgcagccctagggatcgcgattcttcggtacagccgcgcaggccttcggaaaggacgcggcgatctgagtccagggggccacggctccgcgcccgcggtttcggttcccgggcagaccgccgtcggggacccccgggagctttcggagaaggtagggcggagttctgaggcttgagggacaatgagcggcgggtcggttcggttcacgtcgccgtcgggatccggtgcggccccgtccgactttgccgtgggaggctccattgtccgtcccctcccccctttggcggagcgcagggcgaaaggaccccgctttcgccgccgctcctcctcgtacaggccacgggtcttctaggcgctgtcgccgcgcggtcttccttttacgaaactttctctaccgcgtttgcgggagaacactacggcgaacgcgcccgcgggctcgccggcgcttctgcgctactgaatggccgggcgaaggtgcgcgcggggcattcgttctgggaacaggtatagaggcgtggccacggccgaccaatggaccaggcggtgacgcatccgcacggcagaccgcggcccgtacgactaacagcgcggaacgcaaccgagccgcggggttccgctggccccctaatttatttgtccgtctccccgctcgcggatgatatgtcgtacccgcggggctgcttgtccagatagcccttaaaagtccgccgagtgactccccccgcccccccccccccgaccctgacttagccttcactcgccgaagacttcagagtcgctgagggccaagggcgaaggaggaccgggcagcgtcggaggatgaattatcctctgtcgcgcgccctgttcctcctggacggtggtctccggcggaccgccgtccccttccagccacactacagacgagctacgtaggtgagcgagcatctcgcgggccaataaactgcacgtcgcttcgggaacgtgaacgacgactggctgggcgtgcggatcgggggggaggactacggagcggcaaacgtcgcagacggtcctatttaagaaatcgggggaaactatggcgttctttttgggctccaagacgtacacgggacgcagcggggcgtacagtccccacttgagagcggctcggtgggagtgcgactctccagctaaaaagtcggggccgggcggcctctggcgcccggccacaagggccgaggaggctgcgaggtaggagagagcggtcattgggaccgtcgcgacgcggtccagtcgcgtcgcgaccttgtatcggacgttgcttccgcagcacagactgatgtcgccggccgcggggttttcgcggcgaaagtgcgtttccagctcacgtaggaccacggggcccagcacgtcccgcgaggttatgaccgtcgtagctagatcggggtggccaggccatcggacggagcattggctgcggggcgagacggtgcacctgacgtagcggacggcttcttccacgaggcgcgggccgttctccgggcgatcttgatcctctagcgtgtccaggaccacgagccttttttctcgtttcaaacagaggcgttgcaggtgttccaggacgcccgcaaaaccgaggtcctgaggggacaggaacatgacgccggccgcggtcagcgccgaaacgtccggcgccgctctccaccggcccgcccaggcggcgctctccggtaggcagaggcggttggcgagtgcggcgagcaggaaagagagtcctccccggttcgggtcgaaccggggtcccccggggggcgagccgggcgccggtacgcaaaacaggtgctcgcctgggttggccgtgtacaggatgacgagagcgacatcttcaggcgaagcctgctgatgccgcatccaagcggtgcgcgctctgagagagacgacggccgtgcggcacaacactccctcggacgcagcagtgtctgggcttctgctgacgtgcgagggagtgctcgccacgcgagcgatctccgccatggcctccggagaacgcgccaacggctgacgccacagagtcggtatttgggcgaagctggtcagctcgtcgactccttcgcctggacaataggcgtcgaggtgcggggggccggcatagccagcaatcggagttccaatggggggcttcctaaaggcggcgccacgatgccgtcgatcgcctaacgacagggaaccgtccataatgcgcgcggggtcgcgccacggaaagcaacgtgggcgcttgggcgggaaaggcccggcgtcgcggcacgcttcagggggggtggggggccttgtgcagctggcgacaggcggaggtccggcgcctgtccgggaccttcccaaacgcggacgcgggttctcgacggcgttgtccgcgccgtcgagaaccgccgcgggagctgattttctcttccttgactcggctgacgtttgggcgcaaagggcccgcacgggctcgggagaacttgcggggccggggtcgtaacaaggctccgcggagcgcgaccggccctcggacgttccggaagaggccgcgtcggcgtccgcgagaaggcgcgccacgcgttgcagccgtcgggccttctcgcgggatcgtaccggttcgcccctcgacccacattcgcgcaggagcacggaagtaatgtccctcgacccagggcatcgccaaggccgagcggggtctttgctaagcaacgggccgatcgcttccgttatcagggccaccgcattagccgcgagagttcgctcctggcgcccccgaggagccgaaccgttcgcgtaggccgcgtacacggcgctcctgagatcaagcaggtctcggagccacgacccgagcagagcccggcatttttcccactgttcgtggccggcgggtcgagggaagggcccgtcctcgcaagacgacagcatttccgcgaccgcgcccggaccgtcgggtccgcgcagaagcgccgccacgaccccctcgcactccagcgcgcaagcgtccaccagctcgttcagcggccgggtagacgcgaaaccgtccccggcagggatgtccggacgcgcgggcgcgaccaatcggtattcggggacgtccagcaggccctcctctagcgcggaattgaaggccgcgacgccccggcgcacgcggtcgtggatcgtggacacgtctattaccgggatgagcccggccgccgtactttgggcagtgacgggtgcccgatttgaaataggcgatgccgaggggcgtcgcatttcggcgctggctgcagacgccataggcgcgtaggctttcctgagggagcggaacatgaactctttctgatctttgcagtacctgcgagtcatagacacgctggcggcgatgtgcggtagcgcccaaagcagatttcgcttcttcatggcgctggctatgtggggtatgcatttgttgaccgtccccgtgacggccgcgcccggcgaactgtgcgagctctgaaacttcgtgacatagatgtgattgagcgctgcgtcggtgggcgagagcttgccgtggtgtgcccagttcagggggttcgccttcacgtctttgttaagcatggcgcttacgagcgcctcgtactgtttggcgcagttccccatttcctccacgtacaccgggaggggaccgggagtagagaggaatctaacggcggcctgctctacttcagggatgccccggagcgcctgtcggtgtccgccgagaggcccgaaccagcaccggccggccggcggggagggaatttgccaccacacctcttggtcgaggtcatccggcggtggcggcgcagcagtttccgaggacggtgatggcgcccgccggccgcggccgcgccgtcctccgcggccgcggccgcggcctctggcagcgcattgaggcgctcctgcctcgcgggtcggcgacctggatgaggtgcgcgaagaaggggcggcagacgactgttccgatgaagagggcgcggacgacgaagaggacgaggaagaggaagcggacgaggaggaggaagatctggagcgacacccgagcgaagggtacgaggccgggggaggccggggtaggggatgggaagcgcgggtcgccggcgtgccaacctcctgttgtaatgcctgttttagaacagcaggtggagctgttgtgtgcgaaccatcggagcccgatcccggctggactctgcggtaacgttcctgcgtaccggtggggctgctaacgaggcccggcctcggagacggcccgttccagtctggaacgggaagggggggaaacatgggcgctccgtcgtccctcgcgccggacggctgacggaggtgtctgaatcggcgtagcgccgcggcggtgacggcggcgcgccaatcaagtatggctttgtacagaggtctgacccgtttttcgatggccggaccgcaggcggggaaccccagttcgaccatagcgacggcgagctgctgcaccatgaatccgtaggcgcgtgcgggacgagagccgtggggcgtcccgccgggttccggatttccgttccgcagcgccaacttcgattccctgacggccgcggaaagcgcgggagggagcgcggtggcgggcggggggggcatttcgaaaggcacctcgaagccgggccgcacgtcggggccgacgatgtagtcgtctggggccagcagtaacccccgacgcactttgaaaaaaagacacctgtaatgtagcatcttgaaatcgttccaggtgagcccggtccaggggttcgggctgccttcccggccttccacccaccgaatctcctcgagcagaggacagaagttggaggcatagaagccgccgcggcgccggctgcagtcgagaccgcggggggattcagagggcggcgttccgttccagtcctcgtccaagggagtacccgcgcccggcggcggcgcgcacgccggaaagcacggcagaccacgagccgcttgtaattgataggaaaagtcgcgtgtcagaacgtgggccatgtactggacgcgcctgacgcagcggagtcggtccagccagcggtatgaaaggcggggaaccttcgacacgaaatcgggggtgacttgaaggccgaggaagcgaaggagcgccgacaaaatgtaagcgtacgtcggggtgcgcggagccggtctcgggagccgtgttaccgcttcccagatgcgcgttggcagcactatcggggcggggagggggagcgggcactcgttctgcgggccccatccgcaaccctgcgattctaacacgctttccccgtcctcggacggcgacatatcgtccagggtcgagagaacgaggcgcgcgcatcgagaaaacaaccacatcttgcaggccgcccagtcattccccagctcgttcggagggcacgggaagaccggctcctggggcagcgggcgacccttcgcgcaacgccattcgaacggccggtagtcgctgtcgagtaaaggggcctctctcggcagttcgatagaccccggtgaggtccgcagagggctgccgcgcggagtaggtaagatttctctgagtaccgcttccctcgccagccgatcccagtaggaagggcaccggcgagcgtccgacaacgcgaggagaaaaaccttagggttgtctccggaggacggctccgtcgcgccgtcgcgagcccccgcgcgccacaacatagcgtggctccccggctggcgggccaccaactcgagctcttctcgagggggggatgggatcctggcggatgcggataggcggcagacgtactggaagcccgcgcccctggtacgggggcccccgccctcggaaacgctcgatttacggcgggctgggactcggtcgctccggaggggagcgggtgcgaggcggggggctgaaggggacaacggaggggaaggacgctgacaagaagcagagagggctggggggtccggggaaagaggcctgtcgtggagaggggttggcggaggtggggtagacgccggaggcgagtcaagcggtagagacgcagacggggaggatgtctgcgtagagggaggggaggtagacggcagaggcgtggggggaggggaaccgtgcggagggggggtatgcggaggtggcgtaggaggaggggggctaaggggaggtggcgtaggaggaggggggctaagggggggtggcgtaggaggaggggggctaaggggaggtggtgtagggggagtgggtgaatggtgttgagcgaacggtcccggcgtcagcggagaaaatgtccatgggaagttcacgataggttcgggggggggtggggggggcacgcccgagggaggggggagagtttcgacacagacggcgagcggcgtgcaggcgccggtgggcttacagggcgcgtcagatacgcagcggacggggtcgtttgatttgcggggatccatagggctcggttcgccccgttccgaacccgcggggactagatcgccgactgtcttttgccaagaacaggaccgcggggccgccgcggccgtttcgtttccacagacgtccacgatgtccgcggtggaactgacgacctcgccaggagacccctgatgcgcgccgtcggggggttcggcggaacggagacccgtatccgaaccctccgaaacggcaccctcaatgccgaaaggggctcgtgcgccggcaaggctgcccgcgacgggagccgcgcgggcaggggatttagaccgtggcgggacgggctgccgaccgggcgtcgggggcacggccacgctcggtgtattcaagcacacgtcctggtacggatctcccggggtggcgggtggctgcggagaaaatccgccgttgtcggctaacatctctaacaggctgtagaaatcgggcgggttctccatgtccgagcaatgggggaaacgcgcgccggtccaaccgtggcgacgccggcagcactggcgatccgctccttacaggggcgtaaatgcaggggttaatcgggcggatggggaccagcgcagggagcgcggaaggagtcctgctctgaaaaaaatgagggggaaccgtgagaaagcgttccccgcagttcgcatcgcttcttgccccccgcccaacaccaccaccaccccgcccctacacacaccacagccacggctccggcagtgccggcctggctactcctttaatcattaactcccatcaacgcgatttgatccccgggctgctctccgaatcagccgagccccataggtaaacattccgccgcccacaacgtttcttgtcaaacaaacgcttatcggccggattgcgaaacgagcaggttttgccattagatatgctgcggtcagcgctgctaggctccccgggggcaaacattctcctagcgacgccgaggtaaggagacattaaccctcgacacgctcctgcgagcgactgtgcggttcgtgcggtttgtttctctcgctcccgacgttcctaccgccctcgggagagtgctcgcccgggggctagaacccgaagcggaccggcccttgagcatcgagacgcttaggctcgggcgaaccgcccggctctaaaaagtcaagcgcgcgcgtgtatttcttttttttgggggggggggggggggtggtggtggtggttggagacagaagaggagagaaacggagggggtggtggtggttggagacagaagaggagagaaacggagggggtggtggtggttggagacagaagaggagagaaacggagggggcggtggtggttggagacagaagaggagagaaatggagggggtggtggtgggagagaaataccgacggccggacagagcgaattattaagcacccaacgctcacgccaacacgtcccacctctttccccgacccgcgccgccccccccccccccgatattcgcgtcgggggtcagggacaaagagaggcgacggggcaataggcgctgcgtgggggagggggggccggccctacttgcccctaacgcaccggcgtccacgcgatcgcgcgacccgacagcacctaccaggagcgcggtgccggcggcagccccttctcgattcggctcggagctagccgggagagacggccgcggtcacgtctccctttccgaacgcctagcgatatagttacagaccgaagcgagccgtgtcacaccaagtcacttagccgcaattctgttccccttcccccacacacataacaggagacatagcgcatgggaggggctttccttatctctcgagcagaggtcgccgacacgtcaacgaagggcggtacgtgtgtggtaagtagcagagatcggagttggtcccgatttactaacatctaataccgatcgttcatagccgcctggaatttgcgggcataacccgcggataacggtactggtcagggaagcaacgcagcgcagacacgacccgatataaaagactgcaaacgaggttttgtaggggtaatgagatgatgtggaaaagaaatgggtcagggggcgctgtttgttgtgacacatttgcgcctagtgtgggaccggggcgtgcggcgagcacccagcgcggaacgactcgcaagctgacggtgcagggctaactcgcattagaggaagtgtttgctgatttcttcgtagacgctctgcgccgagagcgtctcctcgtttaacctttatgaagaaggaagtcgctcccatctggtgcggaacgatggggtacttctctccgtaatggggaaccgaaaactgaaccaaatacagaaattagaagaggaacatcggcttttcccgttatgtaaaaggaccatggggtcgcgtccgggaggagggggagagtttggggaactcggggccctaagagcgctacaccagactcttcataataccatatgtcaaggcagttgcggtaaatatagcgacgaccgcaaccgaacgggtatttcttctacaggttagaaccatcccatgacccatgcgaaaagtgttacggcacagagaaggccagagggaaactccgcgtccggcaaagcgcacggtaagacactcgcgaggttgtgcaacagcgcatcgccccgggtagaaccgacaggtttatcttcagatggctatcgcggacaactcgtcgtcggggctgggggaggggggggtatgtgtcagccacttccatcctcgtcgctgtcgtcgctcgcaaatgtgggctatcaacgcttctcgattaaaaaaagacaaactagaggggcatccgcaataaacgacaatgtttcatcacaaaacaaatggcgtggtctattctttttcgtttgcctctgatcctgggcggtccgtactgcggggtgatagataaaagaagacaacagcagggaatcgaggtggcgagctcacaaattgcgaagctcagcctatgccggcgatgatggccgatgagggaatgtaggaagagagggcgtatccccgattgacgatggtgcgaccaccaaccgagtccgtgtactcctatcttccattctcacgacaccggacatgagaaacgatgcgcggagcaagtcgggggggggggggggaatgaatccacggcacgcgcagcgcttcctttacattgcaccacgtgaccatattcccataatgacggcaggcgttatctatataatgccaggcagaagtcttacttccgctcgcgatcactattgtcgtcacacggggagtctgactaggcggtatggacggcgtacgagacagagtattacctgatacgtcaacggacaacgagatctaccttgggtcggggtatccggtgcaattacatgatgaatatgggcaaatttctctaggctcgccggtcgaaagcagcaatagcacaggaaatttttgtgctccgccatggatgccggatatccctcgtttaagtaatgatacatgtaagatatttcggtgtctgactagctgtcgtctcaattgcgcaccgttccacgatgctctcagaagagccttgctcgatatgcacatgttaggtcgaatgggattccgtctacgacagcacgaatgggaacgtatcatgcagttgactccagatgagagcattaacctgcggagaactctcctggaagccgacgagcggagcagtcattgtatgccgaacgtgtacgcatctgacattagtaattccctcgaagctggtacaatgcaagttacctccagctccaatatccggggtatcagcaacaagtccgtaaatcactgattacaaaactcactgatgtagacgaacaataaatgtcctattgccagtaatcactttgcctgttatttattgaatgagtatgtcgcgttaattaagtaacgcagtgtgggcgtgacttgtaccatatagatttctattgactacaacgttatccgacctgacatttgggagctgggtgtctatagagacagaaggtgcaccaccgcgcaagataatattgtgatatgtccagtgaggtatgtgaagtaccatcaccgcaaaagcaaatgggcctgtggtcggtgtgccgcaaacttcgcagaacatctcatctgtggccggatcctgcgaatgagaaagtatacggtatactttctgctggtggagtacatatatcatccctgccaaagtctgtacgcggtttggcccgaactgtattgaccgctgccatggtctctttcgcggcaatgaaagctggtatgccgccatccattcacctgtggcgtgagataatggatttaactgacgcaacaatccgccgcgaacaacggtccacatcaaatttctacgtagccggttcgttgaggaaaatagtaagtgttgcattgcgaaattataagcatgcacctgaaacgcatggagaaatggatagccgtctgactgctattatgtattggtgttgtcttgggcatcctggctgctgtattgtttcccatttatatgaggaaaacagtgatctgattaagttgttgggaatggcaacaggctgtggagaaagcccgcttactgaagtagagtcttattggaagcctttatgccgggctgtagcagcgaaggggaatgcattaatttacgacgacgtcgaagtggcacattacctgatcaacgtgcgacaatcgtctgaatcttcgcctccagacgatggggaagacattgagtaaatttgcgcgaatgacagggctcggaaacaatgtatagagttttgcaaataaacactttattgacttaccagaagttattgcatcttattgtaatctgcgtcaatattctctaacttcagttaaaacgtagcaatcgcagaggggcaaactagagaaaaatggacccgcgacctaaatctcgtctaaaacgctccagtgctttacagttcgataatctggacctggggacgcgtataggatcgttcctccacatgcgctgctgtcggtatctcgaatccccggtattcagttgaatcgttggcggagtgtcctcctggactctgcaatgttccctagccgtcttcactatctcgtgcaaggctctataatacagttcctctgcagacccgtcgttgctcttcccttctgcgtcgttagttatttctgtaggctccagacgatttgcctgcatttgtgcgcaacataatctgattgcattccctatctcgtcttccggtaatcccataggtgttcggtattcgcagataggtagagaaagcaccactgcaaatcgtgcaatttccattgccccaaccaatattttttttaagaacggcatcgccgttaatgtacctcgggcattgtgacgatcgaaacccttatggatgcctaaagagagcattgcggtccagttctccaggtgaaaagagaatagcgcgggtagaaacgggccgattagttttatcttcgccgcgtccctaatatcccaagttctgcagtataacttccatcgtccgttttcgacaaggtccggcgcgacatagtttgaaatgtcatctatcagaaacatctcgcccatcgtagaaaaaaacctgtacgcagaccataaaaccattcggtaccacatatccttgtgtatatcaaacgatatgttggttatgtcgttggcggatgttgtatgaaatagagctaagcgttctctggattccacgcactgaacgattccgttagtcaattcatctgctaacataggccaaaagtttattcgtgttacttttctcggcggtttggcaaaacgcccccttggcacatccatgtcattaaatacagcggcataactcctactcatgtgttccatagcccaggtttctgttcggtctgctactacgatcagatcagtggcgcgatcagatgcgtgggatgaatgaagtgtatccgaaagcagttttgagatatacgctaaactgtacgacgattgtggcactaaacgaagctttgcgcgacccccatcccacgcggagtctgtgcaaggttaatgaccctcgcagttcattcggaagttataactgccgccttcgcacatttctttttgtcctgttttgtattgccataacagataggaattgaaacctgatcctcctgttttttgcagcatggccagcaacagaatactttgtcggatcgactacttgcgcgagatggttccgttcttggaggtttcggcgggtcgggtggagaacctattattttatacacacacgtcataccgttgtcgcgaaaatgttctttgtcttctgccgtctcgaacgtcggttcccacgtagacgttaggagcgttggaatggtatcaggaagagcccacggcatgccggaccaagtacccgctactttgaccgcgagcagtctcttcggtaatgggatgtattccagagcagcgcggcagagatcagcggcccccactatccacagactgtatgaagtgttttctgaaacatcggactccaacatcaaatatccagacataacatcttgccattcggaagcacatccgccgacatcttcaaatagcctaactataaacgagtctctagttcctgctaacccagtacctcgaatgccagtcccatccggtgggttcgtcctgataatcggtctctgacgccgaggaagaactaaaaggggtctggaaaagcggaacagatctgcagaccgaacgactacagacacgcccacatcatcatgtatctgttccatgcattgctttatgagaaaaatccataaggccgaggcggcatctctagatctcccggggagtctctcgcactcatctaggagagtgacgacagttatcatagacacgcccatttgtgcaccaaacgaaaagttcctgtactggtggagcgtcggcgcgggaatcggtccgtgctctgaaaccagtgtctagacagaagaccatccggtaaattctggtgtatgaactgacggtctccagacgaacgtcgaagacattaacgatggaaactaacgagctttcttcaaaagtgtctgattacaacgctaatagaccttacgaaactatacgcagcgataccagtgacacagatccgtcggtgtcgtgtgggactctctccgacaaagacggggacgacgaagaatctatagatttaagcaaggtcccgaatgcaacgaatgtcggcgcaggtgaagattgcacatcccccaacgacgggcgcacagagttatgccgtacgacttcggttaccggaccggcctcggtcgtgaggatgcaatacaatattatttcaccattaccgcccagctcggagggccgcgtattcgtctgtacccgttgggacgatgtcagcaataagaaggtgattgttaaagtcgtcaccggaggtagagacccagggagagaaatcgagatcgtaaagacactttcccattgcgcgattatacagctaattcatgcatatagttggaaatctacggtatgtatggtaatgcctaagtataaatgcgatctgtttacctatgtggatagaaaggaatcaatacctttgaaagacgttattgtcattgaacgacgtttgttggaagctctggtttatctgcacggcaaaggtgtaattcatcgcgatgtaaagacagaaaacatatttctggactaccccggaaacgctgttttgggagatttcggggcagcgtgcaaattagacatgcatgataatagtcccaagtgctatggttgggccggaactatggaaacaaattccccagagctcctcgcgctagatccttattgtgccaaaacagatatctggagtgccgggcttgtgttattcgagatgtctgccaaaaaaaggacactgtttggaaaacaagtaaaaacctccagttctcaactgagagcattgattagatgtttgcagatccacgctttagaatttccacaggatgaatccacgactctatgcaaacaattcaaacaatatgcaatcccactgcggcctcctttctccattccagaagttgtaagaagaaatatcccgtcaatggatgttgagtatacaattgcaaaaatgctcacatttgatcaagagtttagaccttcggctcaagacatcctggcgttccccctctttgtgaaagaagccccccaaaatctccaggccctatttgttccctgagtgctaacagcacatgcaatcgaatcccattagaagccgtgctatttaaattttaatgtcgcatagaaatatatggtatacggcgccacgcagagctctatacggcttccactttagaagccaatgttttgtcatcagtgagtaatacgacttgggttacaagagacaaacataatacgtcgaacttaacaaatgccggaatctgtacccgttttctcatcgccgctgctgcatattaacggcaggaagcccttaggtatagcctgagcgtttttacgtccactgcattgccatattcgctacatcacgtatttctacaagaagatgagagtgtctattcaacgggcaattttcctgatatacatatgtacagtctccatgtccagctcggaaaaaactcgtaatgaggacgcctctcgtattagttcttcggacacctttcgcctaaaagaattccccgtatctgcgataccatcgcctctactcgacgtagtcgataactcgtacccgacgaaacacgtcatatacactgacacttgcggtttcgctgttttgaatcccaccggcgatccgaaatacacaatcctcagcttacttttgatgggacgacatagatacgatgctactgttgcatggtacgtcctgggtaagacatgtgctagaccaatttatctacgcgtattttcagattgtcatacaaatgaacaatttgggatgtgcacttcaaaatctccgggatggtgggatattggttatgcaaaaactgcgtatattgaccgtgatgagttgacgttagtattagctgctcctgctccagagttgggtgggctatacacacgtttaatcataattaatggcgagccaatatctagtgacatacttctaacgattgaggggacgtgtagtttttcgctcaaaggcccaatcgacgaccggctctgtaaaccattcaacttttttgtaaatgggaccacgcttgacataggcatgtttcctgcacgaactccccgaccccatgaagaaaacgtaaaacagtggcttacgcgccaaagcggaaaactggatacggttattggtgaagcgtccatgcgtcatgcagcagatttgccacgtgcttttagagattcgtatttgaaatcgcctaaagataacctacctgacgaccctggaaggcctacagtttcaattagcagtatccatgccaatgatgcctatgtaggaagcacctctctgtatgaccaatcgctacgcgcaactgaagagccagtattgccatctgtagatgaggcccgtcctgcgctttatacaaatgcagagaggaaccccaggatgcaactaataatttctgccattgttgttgctagtactgtaatggtcgcactgattgggataagtgcatgtattgttaggaaatgctgtaaaaggaaaatcaaaagagggatacctcaacgcccgtccaggaaagtgtattcccgcctatgattacgtatggacttgggcgtgtcgacacagacacaaaacccagtttgcggccttcttgaaactatcgatgtaatgtctctgtcgaacgggcacatggcacattggagtgcggcgtccaaaaaacatatactatgtttcctatttcttgtcacggggagccattctctaatcttcaccgggacttcgttatccgcatcgacggatcaatcggccatcgttgccttctgtggactcgacaaaacggtgaatgtttacggtagacttttcttcttgggtgactcggttggtgttatttcttacgatggaacgacagaaattctgagatggaacgaaaaactaaagtgtttctcggtcatgtatgccgcgttgtatacggactgcccccttgcagggtctgctttatttagaggatgtagaagcgcggtggtgtatgctacccctcatgacagggtgaagccggtttccgaaaaaggattactgctgtgcatttcagatcccagaatttctgacaccggtacatattacatccgcgtgtccctcgccggcagaaatgtcagtgatattttcagaattgacgtcgttgtgacgagtagcagtattcatacatgcggccatgcggataaaggtatacaggaatgtattaggtatgccgaccgtgtgtcattcgagaactatctaattggacacgtgggacaattgctgcctgtcgactcagagctacacgccgtgtataatgtcactcccagatcggtcgttgggacaaatactgataccatgtcagcttttactaattcgacaacaaaatctgcttcgacgaatttaatcgctatgaagactactcatccaccaagtacgcggcgctgtaacttgaggcgtgcccttccaaaattaatatacatgtcttcattggcaggcctgtgccttctcgtactattaattggtagagcggttgtaaagtgcaaaacgcccaaacccaaaatctacaagggcgactccacctctgacggcatctcgcttatcaattctgcagtaaacgacgcatttgggtgtaatcctgcaaaagaggttgatccctcgaatatttctgaaggcgagaagctggaaaacatgcagaaaacgaccggaaatgtagaaaagtaaccgtgcgagttatgagctggaatggacgttacatgcgggaagaagtagggcgtaactaagtacatgttagaaggggaggggcgggttttgacttttaaaagcacaccgcgggaccacggcggaattatgcttgatatacccgggctacgtggcataatgtcttgtccgcgaatgccccttttcctaatggcggcgatgatgtgcagtgcaaccaccgtaaatcgtatactaattccccaggggaattcggcaacacttaagatctccagatatccgccggttgtagatgggactccatatacagagacgtggacatggatctctaatcgctgcaacgaaacggcgactggatacgtatgtttggacagcgttaattgttttcatgacttaatcgttaaaatggcctgttggcggtattccaaagaggtaatactgcgcactgccagattcgtggtagagaggggcgtgttaaaaacgatagagaccgctaagctgcgcaacgctccgcgtgtattgattgtggacaacgtggacactcaatggactgttttgaatgcgagcgagcaaaacgcgggcatttatattcgatattcccgaaatggaacgagaaccgctcacgtagatgccatagtccttgccgtttctggtcgaaagagaggcagggtgccaccgacagtttatcctgttggaccatttttgcacaaattccaaatctcccttaaaaattttaaaacgttcttatatcaggtgggggataccgttacaatatcgataactacacgcctggagacgacggttcgtgcgttcaagttggagtttcgggtaatgtttctcccctacagtccaaactgtaagtcgttcactatttacgagccgtgtattttccaccccaaagagccagagtgcatatctccgtcggagctatcggaatgtcggtttgcatcaaacgcgcaggtcctggaaattgccgccgcacgctcggtgaactgcagcgcgggccgcgcgtgccattacgatgccgaggtcgacgaatcgatgcagcaaaggttcgcattcctttattcggaaatcccctcgtttacaattggcaatgccgggccgggggacgcgggtctgtacgtcgtcgtcgctctgtgcgatgagcggccgacaacttggactcacgtctatctatcgaccttggacaagatcctagatgtgcacgagatcgctcacaagccgggatttgatgacagagtcttatcgagcaatgacgacgccgctcgcggtgtaagacccggagcggccatcgagaaagaatcaggtaggctccgtctaagcggagccctaattgcatcgatcgtgctggtggccgcggccgtcgtaactacggtaagcttttgcggagcttgcgtcttccggtggcgtcgcaggtgccaccggaagacgcaagctcccggcaactcttgcaagtacatgtcgttgccccaaaatcattgggaagagttttacgacgacgttagggttggcagcgcccctcagtatgagcagtttaaccaaaggttgcccgagagaacgagatcaggctacaccgcttggctctcgtctgatatagccgccgtaagaaagcgtctcgattgaaatcgccgagacgtgcgtgccgattgttgtttttattgtatcgcccgtacttaacggtcctttatccccgcgcgaaataaaactgtccgactcagtctactggtgctcgcgtttacctccactgcgtaccgcgcgccaattttcgtgtaggtgtgcgtatggtggagtggtttgggggaccctgtctctaagccggcacactccacgctatttccccccgcccggtgggcacaagcgcttgcgggaggaaccagttgtcggttttttatgcgggctcctcagcaccttcgccacccacccacactccgcgccccgactgcgcgaagctgccccgtttaggcaaacggggcccggccggcgcgacgcagaagaataaagcagactccgtcgtttcttctataatggagggtatactcgtttattgcgacatcacaccccgtgttgctattttaaattgaaggccgttgataacccgcatcatccactaacgtcgttagcgataacgattgtatcttcccccccccccccacctacggtttgtcgacagctatgataagcggaggaaaacctgcctgattccttgggcggggatccttgtgcgctgtcttgctctgtatgcgccgacccaaagccgcctcctcctcaacgtaaatttaaccgcccaggccgcgtagttgcgtgtcctgaacgggaaagaagttcgttcgctgttattgtggtcattaccgtaactgtcccggcgtgcctccatctgctgagtcccgtgcagactggcatgaggatggttgttcggcggcaggcaactcccccctcatccctactaatcccgaatgcctttaatgatcacgcaataacccctcctcttaacaatatctctttttcgatgaagatttcagttcccccataacacggcagaacgagtctgatccctgatcaattggaacgacttccttcttcagaaaggttaaacgaggacacagtctgcgacgagagggcttaacacttcctcctgtgcgagagcgcgtctctgcgatgtggcttcgccgcaaagtcctttcccatactaggcgtaaaccgcactataacaactccccctccccccagcacccaaggggcccgtgaaaccgcgactggtttcttcttcactggctcagtactgcaaatgtgctgcttacctcgtgattgctgtcgtcggggctcgttcgcactttccaggccaccaaagaaagcgagaccagagccaatcgggaccatctccgaaccttgttcgctaccacacacgtgccgccctttgttgacgtggccgcaaacagagctcgtggccacgccaacgaactgctcgtcctataaaacccctcccatactcaatgccccctgaaatgtttgcaggggggaaagtgaagccttctgcttcattcaggtgttcgcaatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacaggaaagggagacgtgaccgcggccgtctctcccggctagctccgagccgaatcgagaaggggctgccgccggcaccgcgctcctggtaggtgctgtcgggtcgcgcgatcgcgtggacgccggtgcgttaggggcaagtagggccggccccccctcccccacgcagcgcctattgccccgtcgcctctctttgtccctgaccccgacgcgaatatcggggggggggggggcggcgcgggtcggggaaagaggtgggacgtgttggcgtgagcgttgggtgcttaataattcgctctgtccggccgtcggtatttctctcccaccaccaccccctccatttctctcctcttctgtctccaaccaccaccgccccctccgtttctctcctcttctgtctccaaccaccaccaccccctccgtttctctcctcttctgtctccaaccaccaccaccccctccgtttctctcctcttctgtctccaaccaccaccaccacccccccccccccccccaaaaaaaagaaatacacgcgcgcgcttgactttttagagccgggcggttcgcccgagcctaagcgtctcgatgctcaagggccggtccgcttcgggttctagcccccgggcgagcactctcccgagggcggtaggaacgtcgggagcgagagaaacaaaccgcacgaaccgcacagtcgctcgcaggagcgtgtcgagggttaatgtctccttacctcggcgtcgctaggagaatgtttgcccccggggagcctagcagcgctgaccgcagcatatctaatggcaaaacctgctcgtttcgcaatccggccgataagcgtttgtttgacaagaaacgttgtgggcggcggaatgtttacctatggggctcggctgattcggagagcagcccggggatcaaatcgcgttgatgggagttaatgattaaaggagtagccaggccggcactgccggagccgtggctgtggtgtgtgtaggggcggggtggtggtggtgttgggcggggggcaagaagcgatgcgaactgcggggaacgctttctcacggttccccctcatttttttcagagcaggactccttccgcgctccctgcgctggtccccatccgcccgattaacccctgcatttacgcccctgtaaggagcggatcgccagtgctgccggcgtcgccacggttggaccggcgcgcgtttcccccattgctcggacatggagaacccgcccgatttctacagcctgttagagatgttagccgacaacggcggattttctccgcagccacccgccaccccgggagatccgtaccaggacgtgtgcttgaatacaccgagcgtggccgtgcccccgacgcccggtcggcagcccgtcccgccacggtctaaatcccctgcccgcgcggctcccgtcgcgggcagccttgccggcgcacgagcccctttcggcattgagggtgccgtttcggagggttcggatacgggtctccgttccgccgaaccccccgacggcgcgcatcaggggtctcctggcgaggtcgtcagttccaccgcggacatcgtggacgtctgtggaaacgaaacggccgcggcggccccgcggtcctgttcttggcaaaagacagtcggcgatctagtccccgcgggttcggaacggggcgaaccgagccctatggatccccgcaaatcaaacgaccccgtccgctgcgtatctgacgcgccctgtaagcccaccggcgcctgcacgccgctcgccgtctgtgtcgaaactctcccccctccctcgggcgtgccccccccacccccccccgaacctatcgtgaacttcccatggacattttctccgctgacgccgggaccgttcgctcaacaccattcacccactccccctacaccacctccccttagcccccctcctcctacgccacccccccttagcccccctcctcctacgccacctccccttagcccccctcctcctacgccacctccgcataccccccctccgcacggttcccctccccccacgcctctgccgtctacctcccctccctctacgcagacatcctccccgtctgcgtctctaccgcttgactcgcctccggcgtctaccccacctccgccaacccctctccacgacaggcctctttccccggaccccccagccctctctgcttcttgtcagcgtccttcccctccgttgtccccttcagccccccgcctcgcacccgctcccctccggagcgaccgagtcccagcccgccgtaaatcgagcgtttccgagggcgggggcccccgtaccaggggcgcgggcttccagtacgtctgccgcctatccgcatccgccaggatcccatccccccctcgagaagagctcgagttggtggcccgccagccggggagccacgctatgttgtggcgcgcgggggctcgcgacggcgcgacggagccgtcctccggagacaaccctaaggtttttctcctcgcgttgtcggacgctcgccggtgcccttcctactgggatcggctggcgagggaagcggtactcagagaaatcttacctactccgcgcggcagccctctgcggacctcaccggggtctatcgaactgccgagagaggcccctttactcgacagcgactaccggccgttcgaatggcgttgcgcgaagggtcgcccgctgccccaggagccggtcttcccgtgccctccgaacgagctggggaatgactgggcggcctgcaagatgtggttgttttctcgatgcgcgcgcctcgttctctcgaccctggacgatatgtcgccgtccgaggacggggaaagcgtgttagaatcgcagggttgcggatggggcccgcagaacgagtgcccgctccccctccccgccccgatagtgctgccaacgcgcatctgggaagcggtaacacggctcccgagaccggctccgcgcaccccgacgtacgcttacattttgtcggcgctccttcgcttcctcggccttcaagtcacccccgatttcgtgtcgaaggttccccgcctttcataccgctggctggaccgactccgctgcgtcaggcgcgtccagtacatggcccacgttctgacacgcgacttttcctatcaattacaagcggctcgtggtctgccgtgctttccggcgtgcgcgccgccgccgggcgcgggtactcccttggacgaggactggaacggaacgccgccctctgaatccccccgcggtctcgactgcagccggcgccgcggcggcttctatgcctccaacttctgtcctctgctcgaggagattcggtgggtggaaggccgggaaggcagcccgaacccctggaccgggctcacctggaacgatttcaagatgctacattacaggtgtctttttttcaaagtgcgtcgggggttactgctggccccagacgactacatcgtcggccccgacgtgcggcccggcttcgaggtgcctttcgaaatgccccccccgcccgccaccgcgctccctcccgcgctttccgcggccgtcagggaatcgaagttggcgctgcggaacggaaatccggaacccggcgggacgccccacggctctcgtcccgcacgcgcctacggattcatggtgcagcagctcgccgtcgctatggtcgaactggggttccccgcctgcggtccggccatcgaaaaacgggtcagacctctgtacaaagccatacttgattggcgcgccgccgtcaccgccgcggcgctacgccgattcagacacctccgtcagccgtccggcgcgagggacgacggagcgcccatgtttcccccccttcccgttccagactggaacgggccgtctccgaggccgggcctcgttagcagccccaccggtacgcaggaacgttaccgcagagtccagccgggatcgggctccgatggttcgcacacaacagctccacctgctgttctaaaacaggcattacaacaggaggttggcacgccggcgacccgcgcttcccatcccctaccccggcctcccccggcctcgtacccttcgctcgggtgtcgctccagatcttcctcctcctcgtccgcttcctcttcctcgtcctcttcgtcgtccgcgccctcttcatcggaacagtcgtctgccgccccttcttcgcgcacctcatccaggtcgccgacccgcgaggcaggagcgcctcaatgcgctgccagaggccgcggccgcggccgcggaggacggcgcggccgcggccggcgggcgccatcaccgtcctcggaaactgctgcgccgccaccgccggatgacctcgaccaagaggtgtggtggcaaattccctccccgccggccggccggtgctggttcgggcctctcggcggacaccgacaggcgctccggggcatccctgaagtagagcaggccgccgttagattcctctctactcccggtcccctcccggtgtacgtggaggaaatggggaactgcgccaaacagtacgaggcgctcgtaagcgccatgcttaacaaagacgtgaaggcgaaccccctgaactgggcacaccacggcaagctctcgcccaccgacgcagcgctcaatcacatctatgtcacgaagtttcagagctcgcacagttcgccgggcgcggccgtcacggggacggtcaacaaatgcataccccacatagccagcgccatgaagaagcgaaatctgctttgggcgctaccgcacatcgccgccagcgtgtctatgactcgcaggtactgcaaagatcagaaagagttcatgttccgctccctcaggaaagcctacgcgcctatggcgtctgcagccagcgccgaaatgcgacgcccctcggcatcgcctatttcaaatcgggcacccgtcactgcccaaagtacggcggccgggctcatcccggtaatagacgtgtccacgatccacgaccgcgtgcgccggggcgtcgcggccttcaattccgcgctagaggagggcctgctggacgtccccgaataccgattggtcgcgcccgcgcgtccggacatccctgccggggacggtttcgcgtctacccggccgctgaacgagctggtggacgcttgcgcgctggagtgcgagggggtcgtggcggcgcttctgcgcggacccgacggtccgggcgcggtcgcggaaatgctgtcgtcttgcgaggacgggcccttccctcgacccgccggccacgaacagtgggaaaaatgccgggctctgctcgggtcgtggctccgagacctgcttgatctcaggagcgccgtgtacgcggcctacgcgaacggttcggctcctcgggggcgccaggagcgaactctcgcggctaatgcggtggccctgataacggaagcgatcggcccgttgcttagcaaagaccccgctcggccttggcgatgccctgggtcgagggacattacttccgtgctcctgcgcgaatgtgggtcgaggggcgaaccggtacgatcccgcgagaaggcccgacggctgcaacgcgtggcgcgccttctcgcggacgccgacgcggcctcttccggaacgtccgagggccggtcgcgctccgcggagccttgttacgaccccggccccgcaagttctcccgagcccgtgcgggccctttgcgcccaaacgtcagccgagtcaaggaagagaaaatcagctcccgcggcggttctcgacggcgcggacaacgccgtcgagaacccgcgtccgcgtttgggaaggtcccggacaggcgccggacctccgcctgtcgccagctgcacaaggccccccaccccccctgaagcgtgccgcgacgccgggcctttcccgcccaagcgcccacgttgctttccgtggcgcgaccccgcgcgcattatggacggttccctgtcgttaggcgatcgacggcatcgtggcgccgcctttaggaagccccccattggaactccgattgctggctatgccggccccccgcacctcgacgcctattgtccaggcgaaggagtcgacgagctgaccagcttcgcccaaataccgactctgtggcgtcagccgttggcgcgttctccggaggccatggcggagatcgctcgcgtggcgagcactccctcgcacgtcagcagaagcccagacactgctgcgtccgagggagtgttgtgccgcacggccgtcgtctctctcagagcgcgcaccgcttggatgcggcatcagcaggcttcgcctgaagatgtcgctctcgtcatcctgtacacggccaacccaggcgagcacctgttttgcgtaccggcgcccggctcgccccccgggggaccccggttcgacccgaaccggggaggactctctttcctgctcgccgcactcgccaaccgcctctgcctaccggagagcgccgcctgggcgggccggtggagagcggcgccggacgtttcggcgctgaccgcggccggcgtcatgttcctgtcccctcaggacctcggttttgcgggcgtcctggaacacctgcaacgcctctgtttgaaacgagaaaaaaggctcgtggtcctggacacgctagaggatcaagatcgcccggagaacggcccgcgcctcgtggaagaagccgtccgctacgtcaggtgcaccgtctcgccccgcagccaatgctccgtccgatggcctggccaccccgatctagctacgacggtcataacctcgcgggacgtgctgggccccgtggtcctacgtgagctggaaacgcactttcgccgcgaaaaccccgcggccggcgacatcagtctgtgctgcggaagcaacgtccgatacaaggtcgcgacgcgactggaccgcgtcgcgacggtcccaatgaccgctctctcctacctcgcagcctcctcggcccttgtggccgggcgccagaggccgcccggccccgactttttagctggagagtcgcactcccaccgagccgctctcaagtggggactgtacgccccgctgcgtcccgtgtacgtcttggagcccaaaaagaacgccatagtttcccccgatttcttaaataggaccgtctgcgacgtttgccgctccgtagtcctcccccccgatccgcacgcccagccagtcgtcgttcacgttcccgaagcgacgtgcagtttattggcccgcgagatgctcgctcacctacgtagctcgtctgtagtgtggctggaaggggacggcggtccgccggagaccaccgtccaggaggaacagggcgcgcgacagaggataattcatcctccgacgctgcccggtcctccttcgcccttggccctcagcgactctgaagtcttcggcgagtgaaggctaagtcagggtcgggggggggggggcggggggagtcactcggcggacttttaagggctatctggacaagcagccccgcgggtacgacatatcatccgcgagcggggagacggacaaataaattagggggccagcggaaccccgcggctcggttgcgttccgcgctgttagtcgtacgggccgcggtctgccgtgcggatgcgtcaccgcctggtccattggtcggccgtggccacgcctctatacctgttcccagaacgaatgccccgcgcgcaccttcgcccggccattcagtagcgcagaagcgccggcgagcccgcgggcgcgttcgccgtagtgttctcccgcaaacgcggtagagaaagtttcgtaaaaggaagaccgcgcggcgacagcgcctagaagacccgtggcctgtacgaggaggagcggcggcgaaagcggggtcctttcgccctgcgctccgccaaaggggggaggggacggacaatggagcctcccacggcaaagtcggacggggccgcaccggatcccgacggcgacgtgaaccgaaccgacccgccgctcattgtccctcaagcctcagaactccgccctaccttctccgaaagctcccgggggtccccgacggcggtctgcccgggaaccgaaaccgcgggcgcggagccgtggccccctggactcagatcgccgcgtcctttccgaaggcctgcgcggctgtaccgaagaatcgcgatccctagggctgcggaaaccgctcctccggatcctgcaacgagctccgctccgtgaaggtcatctcgaacggatagaaccgctcaaggtcgggggggggggggggggtggtggtagggttaacggtagctgggattgagatgtagcgctggcgaataaataaataaataaatgaatgaatgaatgaatgaatgaatgaatgaatgaatgaagggaccagatgcgacagacatcattcgcgctctctgaccgactcttgccggcggcggcagggggtttcggtcgccctgggtggccgggggggggggggcggggggtgcgtccggaggcagcggcgcgcggggacacctctgttcttacgctgttcgcggagagccctctaccccgcggatcgatccctcgcgcgggagcaatctctgcggtcccctgcgcagcccgcggagcggttcggtccgcggcgcgctcgcccgctcgcccgcccggctatcctcttccgcagcggcaccagaaagtggcgggaacgagcgcgcatacgggagacataaaaatggcgggggagacgggtttctgatcgagtcggcgagcgggcccgaggaaagcggcagcgggacagggtttccggatcggaccgcggcggctaccgaggcccgctgtcgcactccgcggtccctaattgttcgcccgcgcacccccctcccccaccccattcgcgtcggcgagcgggcccgaagaaagcgcaggggggacacggtttccggatcggaccgcggcggctaccgagtccacctcgcgccccccgcggaccccaatcgttcgcccgtgacggtctctggactgttctgcccctccccctttcccccaccacccacgccgcagacctttttcgagacgaaccgcggctgtcctaagtgaccgagacgggcgcctgaaaaagccttgcgtctgatcggggggggggggggggcgcgactccaagcgttagaccgccgaccgccggcggctccgcgcggccagtaggccgagccgcacgctgcatccccgccggacatgcccgccggccgcgcgggcgctcgctaggccgcccggaaatgcgtagcggacccgtgcgcgcatgcgcgcagtcgacatttgcgagcatgcgcgcggcggaccctagcgagcatgcgcgcggcggaccgtagggagcatgcgcgcggcggaccgtagggagcatgcgcgcggcggaccctggccaccaccaaacgtcataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggct

SEQ ID NO: 23 - DNA, 20 bp, unidentified
  source 1..20: mol_type = other DNA; note = cebador o forward primer MDV2-US2-5F
ggtatcaggaagagcccacg

SEQ ID NO: 24 - DNA, 20 bp, unidentified
  source 1..20: mol_type = other DNA; note = cebador o reverse primer MDV2-US2-5R
gatctagagatgccgcctcg

SEQ ID NO: 25 - DNA, 20 bp, unidentified
  source 1..20: mol_type = other DNA; note = cebador o reverse primer MDV2-US2-5R
tgtcggatcgactacttgcg

SEQ ID NO: 26 - DNA, 20 bp, unidentified
  source 1..20: mol_type = other DNA; note = cebador o reverse primer MDV2-US2-VP2-6R
ccctgaagattgcaggagca

SEQ ID NO: 27 - DNA, 20 bp, unidentified
  source 1..20: mol_type = other DNA; note = cebador o forward primer MDV2-EGFP-US2-7F
ccactcccactgtcctttcc

SEQ ID NO: 28 - DNA, 20 bp, unidentified
  source 1..20: mol_type = other DNA; note = cebador o reverse primer MDV2-US3-7R
tgtcttcgacgttcgtctgg

SEQ ID NO: 29 - DNA, 24 bp, unidentified
  source 1..24: mol_type = other DNA; note = oligo cadena superior gRNA1_US2/SB1_T
caccgagaaaaatccataaggccg

SEQ ID NO: 30 - DNA, 24 bp, unidentified
  source 1..24: mol_type = other DNA; note = oligo cadena inferior gRNA1_US2/SB1_B
aaaccggccttatggatttttctc

SEQ ID NO: 31 - DNA, 24 bp, unidentified
  source 1..24: mol_type = other DNA; note = oligo cadena superior gRNA2_US2/SB1_T
caccggaatgccagtcccatccgg

SEQ ID NO: 32 - DNA, 24 bp, unidentified
  source 1..24: mol_type = other DNA; note = oligo cadena inferior gRNA2_US2/SB1_B
aaacccggatgggactggcattcc

SEQ ID NO: 33 - DNA, 816 bp, unidentified
  source 1..816: mol_type = other DNA; note = US2 del genoma Gallid alphaherpesvirus 3 (GaHV-3) cepa SB-1
tcattcggaagttataactgccgccttcgcacatttctttttgtcctgttttgtattgccataacagataggaattgaaacctgatcctcctgttttttgcagcatggccagcaacagaatactttgtcggatcgactacttgcgcgagatggttccgttcttggaggtttcggcgggtcgggtggagaacctattattttatacacacacgtcataccgttgtcgcgaaaatgttctttgtcttctgccgtctcgaacgtcggttcccacgtagacgttaggagcgttggaatggtatcaggaagagcccacggcatgccggaccaagtacccgctactttgaccgcgagcagtctcttcggtaatgggatgtattccagagcagcgcggcagagatcagcggcccccactatccacagactgtatgaagtgttttctgaaacatcggactccaacatcaaatatccagacataacatcttgccattcggaagcacatccgccgacatcttcaaatagcctaactataaacgagtctctagttcctgctaacccagtacctcgaatgccagtcccatccggtgggttcgtcctgataatcggtctctgacgccgaggaagaactaaaaggggtctggaaaagcggaacagatctgcagaccgaacgactacagacacgcccacatcatcatgtatctgttccatgcattgctttatgagaaaaatccataaggccgaggcggcatctctagatctcccggggagtctctcgcactcatctaggagagtgacgacagttatcatagacacgcccat

SEQ ID NO: 34 - DNA, 1362 bp, unidentified
  source 1..1362: mol_type = other DNA
ttacctccttatagcccggattatgtctttgaagccaaatgctcctgcaatcttcaggggagagttgaggtcggccacctccatgaagtactcacgaaaatcagtgtactcccttgttggccagacggtcttgatgccaagacggtccctctcactcagtatcaattttgtgtagttcatggctcctgggtcaaatcggccgtattctgtaaccaggttctttgctagttcaggatttggaatcagctcgaagttactcaccccagcgaccgtaacgacggatcctgttgccactctttcgtaggctactagtgtgacgggacggagggcccctggatagttgccaccatggatcgtcactgctaggctcccacttgccgaccatgacatctgatcccctgcctgaccaccacttttggaggtcactatctccagtttgatggatgtgattggctgggttatctcattggttggaatgacaagattgaatggcataagattgtcggtgccggccgtcagcccattatctgcggctacagctctggtgattaccgcagtcccatcaaagcctataaggtagatggtggcgcccagtacaaggccttggacgcttgtttgaaacacgagctctcccccaatgctgaggcttgtgatagcatcaatgttggctgagaacagtgtgattgttaccccacctggttggtactgtgatgagaattggtaatcatcggctgcagttatggtgtagactctgggcctgtcactgctgtcgcatgtagctaccatttttgggtcaagccctatagcgggaatggggtcaccaagcctcacatacccaagatcatatgatgtgggtaggctgaggacagtgaccccttcccctaccaggacattcccaattttgtcgttgatgttggctgttgcagacatcaacccattgtagctaacatctgtcagttcactcaggcttccttggaaggtcacggcgtttatggtgccgtttagtgcataaacgccaccagggagtgtgcttgacctcactgtgagactccgactcactagtctgcagtagttgtagctggccggtaggttctgggcagtcaggagcatctgatcgaacttgtagttcccattgctctgcagtgtgtagtgagcacccacaattgagccagggaatccagggaaaaagacaattagccctgaccctgtgtcccccacagtcaaattgtaggtcgaggtctctgacctgagagtgtgcttctccagggtgtcgtccggaatggacgccggtccggttgttggcatcagaaggctccgtatgaacggaacaatctgttgggtttgatcttgcaggtttgtcat

SEQ ID NO: 35 - DNA, 171560 bp, unidentified
  source 1..171560: mol_type = other DNA; note = Secuencia del genoma completo del virus rSB1-GFP-VP2
ataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggctgggccgcagcctcccgccgccacaggtgcactcagcccgcgggctgccgcaccccgcgaactgtcggctacaggcagaatgaacgcgcagcattgcgcggacacagtgggtgaccgaagcacaccaccacagactctgaccctgccatagccccgaccgtgaaatgaggcccggcgaggcctaacagtcaccccgaccgtgatacatgacaccaacgctgcccgttacattaaaaggtcctagccctacatgccgtaaccgccaaagccgctacccttaatatgtcctgaccccgactatggactattaccctaaccctgaaaggccataacagtgaccctaacagtcctgacgccgaccccgagaggccctaaccgccaccgtaaacggccctggcccaagcccttaatgtggccctaacaggcactaaaacgaataagacaggccctaaccccgaccgtgatgacaggccgaacccccgaccctaacagaccctatcgcggggtccaataatccgctttcccaccccgtccttcaacggaagagtgcgtgcttcagacccgcggacccgggcaacttgtacccggccccgagcgtctctgtgcaacgcactacattgaaagtaaacaacaggtaggcggtgtcgactcaggtctgtgcgaacgccaaccgctttcaagaacggaggctacgcgcagtcacgaatgaggaagtggttttgtgaggccgatcccctttcctgtttttttgagactcgcagccgattccgagaggaccgggagcgcacgacgatgggctcccgccttacagttttctccgcgaacaccgtactcctgctgggaaggtaagccgcggtccactgtttacttcccgtgcaagcacttccgcgtacgcgattgtccggcacgtccggacgcgcttaatttccgtgtcctgactgcatccggcgactacagcgccgcatccccccctcaaccccccccccgtagattccatggccgagtccgccacaccggctttttggaatttcgcggggggctggcggagaccgcctctgtcccggcgctcgggaagtgcgtacaggatgtttttctttttccggcagcggtgcagcaatggcggggacgcaggacgcttgggaaccgcggaccgcagcctttgcgtcgccgccgggagacggcggcttcatcgcgcacgcgggcgctcctagccccgacccgggctgaagccgtcggccagtacgaataaaaacgcccatggaatgctgctacgagacgcgtccgtccgtccgtccgtctggctcgcgcgcgagcgcatgcgcgcacatccgccgtttccgtaaacaccggaacgacaccctcgccggccccgaccctcaatccgcggcacgccctgaccctataaccattacacgccccgccctaattccgagagaccttaacccctaacctaaccctgttaccctacccctaacaggccctaaccctgacggggagggggaacgcctccttaacagactaacaataatggggggggggaggagggtcgctcctagccctaacgggcccaaccttcgcgcctaccctacccctgccaggccctaaccctactcgggggggggaggggggatgggaacctaagcgtggcaggtcgaaccgtgtggggggggccctgcccgtaacagaccccagcccctacccttacgggccccaacccttacaagaccctaaccttagtactcggtgggagcctaacccgaatagggcctgacattaataggccctaataacccttacacctgtgaccacgaactctgataggccataaccctgaccttgacaggtcctaaccccgggcccctaagccaaacgccgcccttgagaccctaaccccgaggccttaaccctgacccagagaacctaacactgataggccttcgcgctcttagtctctgatcataatcaccccgaccctaaagacccgatccagaagcctaaccccgaccctaaagacccgatccagaagcctaaccccgaccctgaccctaaccctgcccctaaaggcctaaccccgaccctgcacctgagcttgcccctaaaggcctaaccccgaccccgacactacccctaaaggcctaaccccgacaacgacactacccctacaggcctaaccccgacaacgacactacccctaaaggcctaaccctaaacccgacactacccctaaaggtctaaccccgaactcgacccgacccctaaacgcctaaccacgaccccgagactgcccctaaaggcctaaccctaaaccagacacaacccctaaaggcctaaccccgaacccgacccgacccctaaacgcctaactttggaccccaaccctaaccttaacggcatatccctgtccatgaccctgacacccgaccctggcactaacccttaccccgagcccctgcccctaagggcccaaccatcaccctaaaggcccgaccctgcccctaaagacctaagcatgaccttaaaggcctaaccctgaccatgaccctaagggcccgaccctaaccctaacctagtaccctccttccacaccccccccccgaaaaccgagcatagcccaacaatgaactcggccggtttaaagatttatttcgatgcgatgcgcggtcacgcccaccacaaaaatagaccctgcaatattgatgccggaaccagcccatcgcagagcgggcgaccgctacacgggacgcgtattcgtcgggaccgcctttctccggcaggtagcctacacgtacctcactatggccataaagatgcagccatagagaggtacgtgaagaagacccgtcggaatcagaagcaacatttcaggacgtacgactcgagccggacatgataccagacaccggagtccacagcgaccgcgatttcctctgcgcctaccctcggccgacgaacaacgccgagggtaggcgtcgagaaaatcgcgaccgagggtgcgccctcgttccacgcgatcccgcagaacgcttcgcgcccagtctccgtccatcgacgtggtgcttgatgacaggatccacctctaacaccacgcgatgcgctccgcagcgccttcgtcccggagtagagcgccatctccttcctccagcacggtgctcgacgcggcaatacaaaagtctcacgcctcgaacaccggacgaaggagggaactgcgcgcgtctggactttaccggggcggcttcgtcccgcggcgttccggatgacgtttcgagggcccactccatccttcggtgcggtgcccgagaagggatgacgacctctcacacacagcacaaaggacggcgctgggctccgtccgatgctctcgatctcaggcagcacggcaccgatccggagagcgcgtcgcacgtcgcgtcctacccccggagtagtgcatgacggttactccccggcaagcactcgtccgaaggaggacacgccacgcgacccgattcccagccgcttcgcgcccggctacttcttcgcctgcagtccgccggcagggctcgagcaaacaaactcccatctttccctgacggcatctaaccgttaaaatacgacgtcaggcaccgtaagggaaaaaatggaagcagttcggagtacagacgcctaaccacgggccctctctcgcccctccgcgtccgatatgcagatcggtgagagtactgatcgtctcatatccgcaacgaagacttcgggatcgatagacgttatccttcccgcccccccccccccacataggaacctctgttccatcgccatctgttacaaaaaagggcgagcctatccactggcaacgagcgagaacacagctaggcctcccaggtcgtaacaagccacttacgtcgtcgcgggggaaggtcggtccatttcgctcctattccgcaccttcgtttggaacagaagcattacacacaccgccatttccccgcgggcagaattctagtctttttgtggttatgctcccacctacccgcacagacacgtactcacctctcacgatccagcatatcgccgtaagatttacagacattcctccctccccacccaaccgaacactgcacagcggcagcctaaaagtcgctctgcggtcgcatatcccccccaccccccttcgatggtccggtgtacggagacctctcacacaacacaggacaccgtaccacggaccatccgaacggcgggcgaacagtcacgcaggacgtggacacgagtcctgcgctcgcacaggcagctgggcggcggtgctgtcttcctccgacggacagcctacaagcaagccactaggactaccgatacgaccagagtgacgtgcgtgtaagacggcccaggacgaagtcccgcgccccgccgaaaataacagcaccgacctgaaagagaccacgtcttacccaacagccgacccccgaacgatgcacgctcccaagagtcggccgtaggagagcacgcgcccccccatactcggcgcgcgtacccgcggccatccctgcagcgcggcccggcctcgttgcgattcagtgaacgtaccgcgcgccatctccgtccatcggcgtggtgctcgatcccgtcattcggtgatctcaagcaccccgcgaaggaggaagcggagcgtgtaacgatttccgcggcgcgcgacgacgccgcgccgtcccgtccgacgtttggaacgccgcctcggtccttgcgcgcagtacttgagacgatacgtgttaaaatctcaggcaccacgctaaggacggagcagagctcggttcgcttcgctcgcgcgccgacgcatctctgcttcgcagaacctgttttgaaaagaccgcagcgaccaccgcgtgctaccctcggaggggggcatgaggacggcgcccgatactcccgtgcacaccgccgaggggggacacggcgcgcgcgccgatgctcagccggttcttcgcccagagccctcccaaccttgtcccacacgacggggagcggcacggggaatcaattcgtctttctctccgcaggcattgcacaacggcaatgacacgtgcaatgccagcctgagagaaaacatacgaacagtcccgagttccgagtagtaactctcgctttcgcgcccttccccgactcgttccgagcatatcaggcgatacgaggcatttcgcgcgcgtcgccctgtccgtcccggttgtcctagaacgtgacacctctaggggacccgggaaggactggacgacgcgccgtcgtgcggtccgaccgcaatacggcgtcgttaccccttcctcacaacacctgatctcgtggcctaaatacccgctcatcgccccgcatccgacgcctctacctcccctttgtccccaaccgagaaacctatccggggcccgctaaggtcgaaccgccgagactccgtcgtccggctattacccgccataacaagtcgctagtcgaaggatggaatcgcagcggtccgagcggctctcctctgatatcccggcacggcctattgggattaaggtccgggcctattcagattacggttagagtcctcgagaaacatttcagtctctctggcatctgacaacggctacgcgccactcagatgccaaaacagactggatgcgtttccaaaggccatcgtgtctaacaaaggccagtccctgtaactaggccaaacatctcatcaccgtccaagtcacaggtacttcaggtttacggtcgtctgctatctacaacgaagaattcagagccgatctcgccagggccccttctcccccctcccttcttcccccctcccttctccccccctcccttctcccccctcccttcttcccccctcccttcttcccccctcccttcttcccccctcccttcttcccccctcccttcttcccccctcccttcttcccccctcccttcttcccccctcccttcttcccccctcccttcttcctcccttccccccccctcccctcttcctcccttccccctcccttccccccctcccttccccccctcccttccccccctcccttccccccctcccttccccccctcccttccccccttcccccttcccctcttctcccccccccctccccactccctcccttcttcccccttctcccacctccgttcagccttccccctcccccctcccttctcccccctccgttcagccttccccctcccccctcccttctcccccctccgttcagacttcctcctccccaatcgccccccttcgcaacttgcgaaatctagtctaacacgggtttacttacgcggtttacattcacacagcgggtgcatgttttccgctgacatttcccaagccggccacaagaaacgaagcaaaaaaaaaaaagataggggtattaatgcgcgccacccgtcgctacgcagcccgactccaaatttcgaataatgcccttctaggcattggaccgccgccccactccccgcgcaatatctaggcttaatcgccaagattgaccacgtatcccttatcgcgccggccgttcaggccctccccccccccccacgcctctcgactcttttttttttccatgggccgtccagactgagacgacacgtagattcgcggtcgtcccagaataaaggatgaccccgcgatgcccattcccactcgcccgacgtctccctccgattcaaaagtactgcggcacgacctgcgatggaagggaaaaacacaccaaacggccttaagttttccggtttgcctttcccttccatcgcaaatagcccgcaaaagaaggatcgcatttccggccccgtccggccatcgcgactcatccaccggccaaacggggatatcggaccgcgagactttaacggctatgtatttccccacccgctcttctcagaggaatccccgatgcaatctagaagcttatcgttcagagcgtttcgggcacggaacttcctgagaatatagatcatctctcagggtgcaccgtaccacacaacgtttctgtgggaaaacggaaggccagtcactttcacgtagacccctcaggatacccataacagaaaaactcagccccccctcccctcacgaccattttcctacgtggaatgcactacaagtacctgacattttgcaaacagggcgccgagacgtccgatggggttccagcttccgtggcggacgaaccaacaccagtgtgggcgttcgcatctccccccccctcccccccccccatacatgaaagacctacgattactgcataggaccccgctcctgggacaaatactccggaaacctccagggatcggaaatttatttagaaggggggtggggtacagggcatgcttgcttaggatctgctcgaaacttgactataaaaggcaatctgactagaatcgccaaaggcgataggtctcagaagaaaagtaggacgcgcgggggagggataattgtttacgcgggggggaagataaatggcccacggcggaaacgagaaagcgcgggggggggttaggccttggaagggggaaagacgcattcgcgcatgtcagaattaagatggcttccctataagacgaacgcacggtttaacagaaaagcggacatcacgccggggtcgaacgcgggaaaataaaaccgttgcgggggggggggggagtccgaaccgtgcggcgggaaggctccgagtccgaccggaaacggaaaaaggcggcacggcacggggcgctcaacgcacaggggataggaagaatttcccctcggcccgcggattcggatcgcgctcgcgatccaccttttctccgccgactcgccgaccgcccggaacgccggtacttacgcgctggagaagccccgtattactcttcttcccggattcggccccggcgcttctgcgtctgcgcggcggacatacgcagttgcgcttccgtcgacgtattcaatgtaaacaaggaagtcggccctgcgacttccgcgatcgcgatcgcgaaccggtaaacaacgcagggggagcgcggagcgcgggcgcgggcagggagttaacctcgcgatccgaccgcgcattcggatgtgcgggtcgggggcgtagagataacgcggcgtttccgctccgggccggagaggctggcgggcgggtctctccgtacattctttttttttgcaaacgcgccgctgcgcgcctaaacgccgcagcggcgcgaaacgcccgcgctctctaagcgtccgaaggccgtacggacaccggtgcgtccgggcgctcggccgggcgaacggcggagcttttctttctcttttcagtctcggagaaaacggcccggtgcacacctcctctcgggagcgtcgcaggaaagtaagttcgtgtcactcaccacccccccccccccgccatcgacacggagtctgagcatgagggctttaataaaccgatttgaacgtgctacgacgagagtccgtgcaagtgttcgcgctcgcgcctatacgtactacgacagccgctctgtagccgcggtgtgtgtgggggtgtgtgggggtgtgtgtgggggtgtgtgtgggtgtgcgcgcggccgggacgggattcctgattccgtagcacttcatctcgaatgtggaattcggttccgacgggggccgttaacacatatacgcgacactggtcggaactcgcgacttccacggtcgccgcgtaagtcagtggtgcttatacgtgggaacgaagcgaggctaagtagcaggtcgcgaacaaggaggtggaccgcggggctgtttatatcgcatctgcgtctcccgcggggccggtgagctaacggctcctccccgtcgcgaaactgtatcccccgcacaaacacctggacgatccgcgagcgacttatgatgcgcgtgcccctcccccaactaacccttcgcgcgcaccgcgggcctcggcgcggtacgttctccacaacactaatcgcacgcattcccggtcgcccgtcgccccccccctcgcacatcccgcctcgggggagaggagaggacaaagtacgttccccgacttacgcgacggactcccccgcccgcgccatcgccagacaccgaaacgggaccgaagcgagaaagactttttaataaacacgttcatacgcactacgacgagaccgctcgcacgcggtctcgtacacgcacgtacaccttaacgatcgacgcactgtacgcgagggctaagagcgggcgagcgatccaccccgtttcgcaagaaacgacgcgtcccgggcgcggctccgctaagcattcgtttacacggcagtttcggcgtctccctcctccggtcgtccgtaggagccctctgcgtttccccgcacggccctcgaaaccaaactccacagactcttccagacgtttgcgacgctaggctggcccggggcgcggacgcggtctgagggcttgagccggtggctgcagctcgtgagagcgtgttcgaactctgaaacgtaaaacggtccggctcgattccggataacgcaaacgtcttttcccctcccccccgatccggcaggcgagaccttcccactcaacctcggtcccgcacgggcttgggggggggggggggagggaaatagccggccgaaccctactcgggcccggacccaaacgacatcgctccaaaagagagcgttccgtttgacggagcccgcggtgcgtacctgcacgggattccggatcccgatcccatagcgaccaatctcgaatactgaactccgttgttccgtcggaggccgttaacacatataggggcaattggtctgggctcacgattttcattgtcgccgcaaaagtgagtgtgcttgtgtgtgcaacaaagcgagaccctctaccctgttcgtgaggagagggtcgcggggttgcatatatgtggcatatgcgttgatcacgggaccggtgagctgacaactcctccccgtcagggaactctattccccgcattaccacatggacgggccgcggcgtcgcggcgtttcccacacccctccaccgaccatgccccacccccgctctcgttcgagaggccgtcccctcccccatttcgttccgcctcgtccagagccagcgcgggacttcactttttccccatccctctactcctatctcgttgcccagcccacgatcgctatgtacgcgttctctccgaggccggctcgcgccgagccggccagacaaagtcacttcggaactgacgccgaagtgagtgctgaacggttgagggggcggcgtatcgcggataagctattctcctcggagtctttttgcggcaggccgcaagcttcctcgtacccccctttcggggttcgctagaactcgatcgaaacccgagacgagttactactgagccgatccctacagctcgggaccgctcccgaacagaacgcggcctcatcgggttctttcgtagagcgccgcaagggcagaaacggaccgacgcgcgtccgagactcatcccgagctcacgccgaacggctttattgctccgcttccgaacgagagagcggtcctatctcgaccggcccgttttcaatcgattcccgaggttccgacctcgccgcgggtgcggggccggggggaaagtcggggggcgacccgcgaccgtgttccgcgagcggcgttcggccgcgtcgccgacgcggggtcggatctcgttctcgtgcgagggatcgggacgatccgcggacgagaacgatggggcgtcctccctcgacgtccgacggttccggacgccgcgagggtcgcggcccgaaggcggagatgccgagctcggccagttcgatgccctcggtacccatcccccttccacccgtcggcgacccccgcgaacgcgagccgtagacgacgttctcgggacggcgcgcgatcgcttcccggccgcctgcgatcccaacgggacgggttcgttcgccgcgcggttcgcccggcggtaaaagaacgaccagaaaatccgatccgcgacggcgggcgctttattaccgcggtcccgcgctttcggacggcgggccggccagcggaacgacggtccccgccggacctccgctcgcgtatttgtaggccggaggtccccgaatccgcccccgtgggaggggggcggcgtttctagcccccggcgcgggccgcggccggacacgaacacgtggcataggatcccgcttcccgattggcccggacgggcgttcgcaccttgcgccaataatatattatatatataatcttatattggttcgcggtgcgaacgctgacgcgttcgccccgctcgtttgcattgcatcacgtgatcgttacgccctcacgaccggcccggtcataagaagcggaggcgccggatctccgcttagagcgccggtccggcgcttcccgcgaacggacgcaaggtggcggcagaggataagcgatcgccgaacgagagccccgtcgggagcgatcccggatcggacgccgcggcgaacgcgtaggtttcggccgtctcccccttcccttcccccacacatcctcccgccccccacaacctcctccccggcggcctcggacggcgcctcccccgctcttcccgaactgcaggccggccggctaccctccctcccccctctcctccttccccccctcccccttcttctcccgtccgaccggcccggcggaacgcgatgcggcgggggaaaaggcgccgatccgacggacgcgatcgcgacccgaccgctgatccgcgcgcccctccggacgccgagagggatgcggagcgcgagagcggagccggggacggagggggcgacccggacgccggagagaacgacgccggagggcgcggaccgggcgcggacccgggcgacgacccgggcgacgacccgggcgacgacccgggcgacgacccgggcgcggacgcgggcgcggacgcggacgaggcgcacgcgcgcctgctccggcgcgccgagcgcgaaaacaagaaactccgaaggggatgtaatttagtgtttactataagcaacaaaaccctagtagtcggaacatgttttatgcttgcggcaggtgtactagtcggtgcaagtggtgctgaccacgagactgcatgcaacaaaactaatttgctgttggtatttgttactgccctcttgacacgatttatttgaaacggtaacgaatgctcgtgtactttataattgcatgcccgattacaatctgttctgtaagaatagttatacgtagcgtgttttacatagtcttcgatgtatagaagagacgcagtcaacttgccggtgccgtgaaattgtctccacactatgatgtttttactgttacaaggtaattaaagaccttcgagtttttcactccacttgtgtgacgctccttcgattatgagagtacaatgtcgtctaagggggatgtggatcaccacgcgggttatggggtggcactcgcaattattgctctattgctcgtacatgctactgcactgattatggtgagtgtctttttacctctgtcccatcagtaattgctaaacaatgattgttttaatgccaaaaatctttttttagatcttttctgatgtcaaattcagaccagtttcacaggatcttagtacgcagtacccatctcataagcattatgatgatgcgtactcgccacatatgtctggggtagaccacggccattcggatgtatggactaacactgtaaatgacccatccggcggaataaactcaaatttgcctggtgcgaagagcgtggagaagatctatcctagcgtagaaccaagtacgtcgcatgacaaagtgtcgtatggaaatgcatggggaggggacataaacaccggcagtgtttcaccttctgatgacaaagcattgcccgccactgtcgaaccatcgacggacatcgtttccatcgcgatcacggggagcagtttaaacggagaaagtagttggcggatttctaaggatggcccgcgtcgggtttatacaccacaccagactaaaagaagtcctcctcagatcgatggcacgcgtttatctactagaacggcatacttgagtgtgtgggatgaacaggaggggatttttaaaacgttcccggccaatgctgctgcattcaatttattggacgctaatcagttagagaaagcgcgccgtgaagtttttttcgttgtgtcggtgtggcatggaaatacgaacgaaacccgtatatttttatccgccacgaggctactgacgcgaatgatgtccacatcgctcgtcgtttatctttcctgggactctcgaggggccctggggacgacaactgatgcggcttttctggcacggagcgtaaatatatcccagttcctgaccgctgtaccaccacattcgcaagttcgttgtatgggccattcattaggaatgtatacttgcggttccatctgtagacaatataatagtgtaggtacgaccagatgcaaaagcattttaagtattgatccttacggcgcctcatcacccgagtctcatgtatcctcggcagacagctcaaatacaatacgctttgatgccgactatgttgcgattttcgcaacaagtaagtggcacttgaacacgtccgattcaaacgcagacgaatatataatagtagatggcttgaatgcaaatgctgtgtgtgtcgatccctacgagtggagtgtcttattgtgtgttagcaatcgccaacgaaatgccgtttgtgagcgattcggtgctaacaacgtaacgactaccggcgaccctgcggaagacggttcggaaacatgcatgcgaatactccctatactatcggtgctgcagtcgctcgataagaattctgcgtatccgctgttacgtatggatccgccgggagcttctgcagcggtaccatccttaccgtccacatggaatatctacgtgatgggaaaggattacagatattctacttatggaaaaaatgagagcctgtggtattctagcgccgtgcatatgggaggaccgggattctttcctgcgtcggtatttactgtgtttcttccctcgggtatacccgctgtggtatccaatgtcgtgcaacacagtagcatcagttacggagatgtagcggttcattccgctttcttaactgataggtccctctactacccccgagtgatggtccaaacatccgggcctattttatctgcctattcttggagagcgcgactgcataatgacagcctctatttattaccacttccagaacaggagataatgcaatacaaatgcgcagttgcacagggaagctatgcatgtagtcccacaggcccgatcttgacaactgttatgtggcgttcactgttattcgcgggcagatcttcgccggtgcccccaaacggtagttgtttgacttatatccccgctaacacaatcatccggagccggtcccccattgaaataggccctcgaagtattataactgcatcgtttcagctaagcagacaattaatggctatgacgctcgaaaatcatttcacgtccacgaaccggactctattgacatttcatgatgtgtgccacgacactgctatggagtcggatatatacttcgagtataactggttaggcgcatcgatgaacattaccatactgaaccccggcctctatacgtttagatggtttttcccatttgaggttttcgtaatgccggtggtagttacgcctcccaagtccagagcggataccgtcacgatcgctcccgtaggactataaccctgttggacaaataaagtatacagactgttcaaactgtgtagtgagtccatcttagtcgtactggatgcaaacgagcccaataaagtgtaacagttgggaaaactttaactgtcgtgggataacccttataatgttatagtgcagtgactgacttgtaagcaaacattgactggaagttagcttatactgtacttcgtcgagactgccgttgccgactgtacgatggagcggcctctcgatcgtgactatcaaagtgcgataacgtgcttgacgtgcgagagagtacttttttgtcgcctctgacatgggcaggttcgtggcgataactccaactacatcaatgccaagaggtttaagcgttaggtcgccggtttaaatactcattcggaagccgtgggtggcgcctcgcgtaccccagaccgttgtgttataaaacccagactcgtcgccacacatgtaggcaaaaaaatgactagcgaaagagctcttgcgctagcacccggtcgggcggccacggcagatttctacgaagtggatccggtatatcggcgagacttcgcacgccggcttttacaacgtaagttccagcttgtcgtgttgtagaggtatttactactctgatcttcacctaattagcaccatgccgtttgtatttaggtttattccccaagacgcttgccgccgtcagggaatcggagggaggccgaaacacgcgcccgcccaaaacagatctgtgtacgcttttgcgcataatcgcgcatcatgagaccccgcacattttcaccccaggtcccagactcccgaaatcctcagcaattgtcgacgggctatgggtagcgtgtcgaggacttgcggcagagtgcatgttcgatggccgggcgacaatagagttagcagaacgcctcgcaacttcatggttgacggccataagattaattctagtttggcatcccgtgtatgccctcggccagcaacacgaaccactcgagcggatatgtcgccaaggtcgagaatatattgctatgctctcgggaacgattcaaacatcgtatgcgacatggccgttttggcaaatgatgcaacgatgcttagattggtgctgctcatttcacatccccgatgaccgttcttgtgagcacggatctccacgtctggggatccaactagagggcgaaaaccagatattcgcgccaagtttggggctctactccgctgtaatggcatggaccccaattccatgtcacgtacaggttcctgtatttccgagacctggcgaatcggacgatgtctcgaccccgcctagtggggcacagataggacgggtgcgacctcacagtcttcaaaggctggcactaaaacacagacctattgatgccgatgtacatagacccatgccgttaggccggccactcccttcaatgcatatggacgatccagacgatccgcaacctggaccctccggacaaggccgggcgcccagaactccaactctggaaggagtccgggtcgcagaacaaccggtaagtcttcgccgcgcaagaacaccaccgccgccgctcaatgtcgacgaagacgacaacgatcttcctcccggccaacccccccgccctcatcttcgaactcccccatcatcaccatcgtcctccgagactgaaatcgatgaggaacttaacgcgcaacccgatccttggggtacaaaccgtagctctacccctacagataactcctctgccagtgaggatgaagccagagggagcgggttgccccgaccattgcgcagcgcgactactgaaccgcgcgtaacgcgtagaagccgccgtgaggctcgcagccggagccgaagtcggtctggagaccggaggtggggaccgtcccgattaaggtcaatgcctggacgcaggagagcttctcgacaagatacagtacttgtagacagttctgaagaggaaccgtagccgtttgtagtcagggttctagttaagtaggcgccgcgcgatttacgaattagtacatttgggccctgccgcgcagcgagcgtctcacgactgcgatagtcatgcacgtttcgctggtatgggtgctgtgtttgcttttcggaactagtgggggtgttttaaagtggtctgacgttgacttgtcgcggggattcatttcggtcccaaatgtaagttcgcttatgcttttagactgcgctccaaattcgatactctcaactgccagattcgccgatctgacaacagatgatgtccctaccggtatatttattaagatcaattgcagcgttccggaattcattttatggtatgggtctaaaagcgtggcggcgcggctcaacccaattattgcaagcgctttaatgatggacgatgttttaaagagcggattggacgattccgtgaaggcggaacttcgcgtgtttttaaaaagaatatccgaacggctaccttggagctctctccggaaaagacacggttgtctgaacctggacgcaccttatgacttctcctgttatggctcggcacggctcgacagatttgaacgagacatcgaggacgatggccgcggaatgtcatgccgagctaaatcaacccgagctaaagcggcccgcaccaacgccatcgagggatagttcggccgcgattaaaaagcgtcgccggccgatcggacctccgcccggtttcgcgccactgggcgataatgcgccatccccacagggtgaaactgacgcgtacggacatcaactgtcgatgaccgaaaacgtccgcgctgaattgtggcctgttatagccgagtcttacaacatagactggagttggaaagattggctgctccccgaattatgctgtcctaacggctccaagttgttggcggaatacgaacgccgtgctgcggtagaagacgtctttcctccgcgagcagatattttcgcgtggactaagtactgcgctccgcccgacgtcaaagttgtgatcgtcgggcaagacccgtacgttcatccgggacaagctcacggcttggcatttagcgtcaagcgcggcattacaattcctcctagtctgcagaatatattttcggcagtcaaggcgtgctatccctcgatcgaactcggagcccacggatgtctagaagactgggctaaacgcggagtcctgttactaaattccgttttgacagtaaagaagggggagcccggatctcatcactctctaggatggcaaactctggtgcgaaacgtgcttcgaagactgtcgttgtcgactcgaggcatagtcttcatgttatggggagcgcgggcacagactatatattttcaaacggatcgcgacgatcgacatttggtgctgaaatacagtcacccgtctcctttatcccggagaccgtttgcgtcctgcacgcactttaaagacgccaacgagttcctctgtaaaagcggtaaagggggcatagactggagcattggcgcgtaagtgacggaagggttaatcatcacatgcgtacaaaagtcgcagcgctctaggacttgtcgctttctgcgcgcgcaatgaacgataccgcaccttctgttttggcagtattatccaactggggttggaagagcacacccttgggcaccgtaggccccgtcccgattcgcgacgagactgagtgcgcgcgcgaagaccttccggcacatgattgcgaccactggtgtaaaaccgccaatgcagaaaacggacctatggcaccctccccggggaatcgagattttgcgggaaaccaagaatacacacatttcgacactctgtttatggtctcgtctctcgacgaattgggaagacgtcaactgacagatactatacggagagatctaaggcattctctggccaagtttacaatagcttgtactaaaacctcctcgttttcttcctcgcacgccacgaaaaaggttcgcgcgaaaatgtttcaaagagggcgtcagagcaacaagagcttgcagatgtttattttatgccgcagggcacacgctaaacatatccgggcccaactgcaagcggtaattcaagctcgaaaaccccgcaagtattacacccgcgccgtggacggaactacgcatccggtggtgcccgtctttgtatacgagtttgccgccatagacgttgtcagtttgcatcgagacaacgtgatagaggtagacactcccggctcgtgagcttctcgccgctcatcatgttcgtcgtttcggcagctttagcatccgcatcagactacgccgcgtttttgcgggacaacaagcaagctgctcgcaagctgcagtttccgttgtccccgatgccgagccaacggatcccgcatctgtctaaggatggcaggactgcagtcgcccgggaaacggggtcgagcgaggttatgtcagcgagcggacagaacgcgtcgacccgaccggtcgacgctcgtttcgccaacctagacaccgagaaatgacaagaagcatctaaaacgcgcttgattgtcgagtggctgaataaaatctttattgatcgactcgctttcctatttctgatttaataaccatagatggggcggggaatctataaaataggcaaggtccgcgcggattcgagcacatcgaccgcgtccgcgacacagcatgcaagtggcgacgaacggtcctcaggcatgcacgactggtctatctgtatatctgcctcgcggatcgcttccgtgagaaggtcttcctcgtacccggttgagaaagcgtccactttcgagggtccgtacccgtgcacagcgccaatttcgtgcgcttcgatgcacttactaatctcgggcgcgttttcgggcagagatcttatcggatcgcagctctgtcgatgcgcatctttattagggtctgcgatcgcttggcaatacaatcgcgcgctggattcgtgaccgacccgcattgcattggctgtttgtgtcaaagagccgggcttaccgtagatggtgatcgttatgtacagtgacgttcccatccacataacggttaaaattcctccggaactgctgtataagtaggcatccggccccgtcacggtacacgtagcaaatggtatgacgcacagggattcgggcagaaaggagagcggcgcggcatggtattcggcgccgcactcgccgacgcgtagaagataagagcaaatgtccgcgccgctgtcgacaatgatcagggtacctaccggtcctcgctgtatgataaagttcgacgatgggatatgatcgcatctggtcatcttaccaacggcaatcgagcgcgtaccgcctgcacatgagcaaaccatctgctcataaggaggcattgtccacgcgggctgagcagtgacgttctcaagcgtatacgcgatgaacgtggaccccatcatatccacgtctcatgtgacggccctatgcttcatggccctagttagtatacaatgtggactttcggatcccggagggcggctaataagtgcgcgctgatattgttatcatccctagtatgcgtttcccgaagtgggttaatgttcatcctcagaaacttagaggaggtcactcgagacatggccacgtagacgctgctgagtttgatgcccgattgggcaaaacatatagcaaccctctcaaggctaagcccttgcgatctggcgatagtcatcgccagtttggagcttattccgtagtcggcggttacggccatccggagttcctgatcgtctaccgtttcgacaaaatcattgacgttggtgttaattgctgccatgaaaccgtgttgatctttcaaaaccagggtcggcatgtgaagttccccgagcgcttccgcgacctggggatgtatcttacgtctaataggctcgtctgcaaatgtgttaattctagcgtatgtgtaacccatgagagtgtagctgtccgtctgcaaagcgagcgatagcattcctccgcgcatgctatttataaatatttcgcaccctttaaagctcacgttgtcgacataactatcgaatctggacgctgcaaacttttgcccgaatagctccgtcaggatagaatacctgcccataaacatgctcttaagcatgctgaactgggtatatatctccgcagaagtttctgcgcgtccaaattcgtaattgcaataaagcatgtctatcatctggtcgtcgaaatccataaatagggcatcgtctgtatcctccacatgactgatttggtcattagctatacaatctaattccttctcactgccatagcggtgtcctggaatcgcgaacgactccctctgctccgctctatccggaggttgccgtcccggatagagcagcgcagaggtaagcatcgccaatctatcgtacgcgcttttaacagaattgtctggaagaccctgccgttgcagatagttgtagaactgtatcatgccgttgaaaagcagttgagataagaaacggtacacgtattctacagacccatctccgtgcgtctttatgaaggaatcgtctttcaatacggatagaaatgtctcgaacgtcccgcaaaagccgaaaacccacttccgaagtcgggtagtaacagccacttggctgtttaagacataggcaatatctacacacgataccgcgagcccctgttggctgcgaatttcacatttggcctgtgtggcatcttggtcgcgactttgcgaccagttgctcaagcgtcccgcattggcagcaagccatttttccaacgtaacgtgcggttggttggcagcagtacgatatcgttcgaaactatccaaactgacgaaggtataagccggcagggtaaacactacaaatttcgtatttccggacgttttcaggtagtcgtgtaatctgctcatgtacgcgctgacttctttatgggacgaatacagacgcgtccatcccggaaggttcgcgggattgttgatgtatgcttctgggacgacgaaactatctacgatccgagcgtgctcctcggttatgggaagaccatactctaaggtcttgaggaggtccccgaactcgggttcggtgcaccgtttgttattaatgaatatcgcccagttcttggacagttctaagtacgagcgcaacgtctggttgcatataatatacgtaagaatattttcgctcgtacgcacattacacttcagcttgctatgctcaaatgtggactccaaagaattcgtttgcgtgggcgacccgacgcatatcaataccggcctccttcttctacagtactgcggcgtgcggtaaacggcgtttgtgagccaccaactgtatacgatagccgtaagcaaatactttcccagaagtccagcctcgtctatgacgattatgttactgcgagtgaacgagggcatcgaaccatgtatgccgaagattgtccacgccatactaccgcgaggcttgcttagcagatcctctaacgcgcgaatcatttcaaaccgccctggcccgacctcgttagacaccgccttcaaggcgcattttgtaatgtcggataaaacgtcccaataatacactatatcctttttctgcaattctttcatcgtcggtgggctggtcggacatacgtactgatattttcccaaattcgcttgaatgtgattacctttaaacccgaattcctgaaatatcgtgtttatgtgctgcgatgtgtatgaattgctaagcttgcaataaatattctgcgctgcgacctttgtcgtgccggtgataatacagtccaagatttcggatagcatctgtatgcacgtgctttttcctgagcccgcatttccgcttattaagtaaacggcgaaaggtagctcgcggagttctagatccaacgggctttctagttttgacgcgttcataaaatacgatagcggggggactatatcatcgctcaccgatgcgtccgccaggctccttacacgcgcaatgatagtctgtatcccgtgcatcgcagtgaaatttagatacgttgcctcactgaagaaatcgttctcccgcgacatcgtcggtcttggggaagacgggagtgacgaatctacgtatcttttagggtcggggctggcgtgttgtttatttccgatggagagctcagacgttcgggccgcacgcagtcccgccctaaaacaaattcgacggccgcagttgcaatctgtcacgcgccaatggaaactttcaagcgacggcgattcgcaacagtccctggaacaggactggataataattcaccctactcgccaaacacgtatgttcaaagaggtcctcaccgggcaattgggatatacagatggacagggcatatataactcggtacgatctacagaagccgcgattcggcagattcaaagtaccattctcaccctttctttagatgcggtcagatatgacgacttgaaagaggattggtcgaagcatatggataggcgtgggatgtcggccaaggaaatcgcaaaaaagtatggcgttcatagtgaagccgaagctgttagaatggcaaagggggtgttttcaacttggcgtaaaactcttcaaatgaccttaatagaattggttcggcacgcaacagattgcttcgccgcggccgagaaaaccacgtcctgcttctctaaatacatagactggatctgctgtttaggtatcgttccggtcgtcagaagcgagcgctctatgcaggcgtcgcggccggatagcaactgcagagatcgcgctaccattcgcccgaattgggtattcagcgatgccaccgctaagctactagttgcggatagcgttatggcccgcgcacaacaaatcgcggattacttaactgcatccatgcaagcactgactgtgatagaatacgatagggcccagatagaatataatttcttaaaacgtgaacttcgcgttaaggacgtgttgagcggcgaacgtggcgagtgtatcgttatttggagaccggtaatgaacgacggaggggtaatttttgattcgcccatgcagagaatctacaaggagatgattgaatgtcacgatttgcggatgcatgcggcgctgtgtcggctagtaaacacggcccctataaaggtcctcatcgggaaacgcgatgaggatagtaaaagcatggccggggctcaaagagcaatcgataaagttctgggagaccaaactgaaacggcggcgagctctgccgcctctaggttggtcaagcttataattggcctcaaaggtatgcgtcatgtcggcgatatcacagatagagtgcgggattacttggaggaaaccggcggacatttattggatgcctcgcccgtggatacatctcagcctggcttcgggcgcgctaatcgaccacagagttctacgatatccgatggaacttgctccaataccgctagactacgtgatgcgttccacgcgtccgtcgtgacgagtataaacgaaatgttagagggctatataaataaacttttccataccgtggaagggttaaaggcggccaataaagacttatctgcaaaattaagctctaaagaaatagagctcgacagaatacgcacggaagccctgatctcagaacgggcgcgagctgacgcctcgtgcgatcctcactgcaatccaaccatggaaactttggtgcgcgagctaaaacatgacgtaattgacgtaaccaatgcaatggaggatgagtcctatatcgcgaatagcttccagtctcaatacataccatcatacgatggcgatttgaaacggctctctaacatttgggaacaggaaatgttgaggtgctttaagatgactcgtatcaccagtaatcaaggtcgagaggtttcgatctcctactcaaatagcgctataactttattactcgccccctatttcttctccgtgttgcagatctatgatattggtgcgatggtcacgagccaagacgtttacaagtcggaggaggagttatgtaattccgtgcttgaaaaaacccgactttgtacatatctggatgatttggctctcgtctttgaggccgatgtgaaaagagctgtcgcgaagtattcgctccgtgcgggtaacgccgaaatagacttagcgcccgaggagttttcgtacggctctcatggaagcaaatgcgagacacggttttcatccgctagacacgagcgacacgttggacgctctagttttaagcacgctaaatggagaagtcggccaaaacgagaccgtagaagaactaatttggcaaccgacggcgcggatgatgatggagatccgagagattcaaggcggtcctactcaattcacgggcgtctccgtgagtaaacttcgcgtggcaagatgtgatacgcgctttcatctgactttaaccggagccgacttggatgatgaaatggcaagtgacgtataccacagtcagtgcatagttaattcggcgttcaaaggtttcgtctttatggttctcacggttacggaagatatagtgcggacgataggggttccaccccctctgctaaaatacaggctcgtgttctataacccatctgaacatttggacttcgcattatgtttgctcgtagcctatttggagaatctccatgcaagcgcctgcgacgtaacttttttcgtacaggttcaatcttttctgagatacgcatggacacgggtgacgccaatgaccaaaatgcgcagatttttatgcgccacgaacgtttggttactaaacactttgatgtcgatggggtcctgtagcccattcgacggagatcgagtactcccccattatgcgatatacagacatttgtgttctaccagtggcgtctgcgacgtgttactaaccttgtttgaacccgatacacggcaggtacgtgaccgcacgcacggcaagggacttgtcatgctcaacagaggaattatgaataaggcttttcggcagacatggattagtgatacggtctacgattggtggaccggcgaacgcgagaagttgatcggagaagaatctctgttcaacacgtataatatatgaataaagtatgacaggcactgctataaatagaccgtggtttcttagcgttttcatttatttattgcggacgaacagaaacctgtacggctctacgtcgaatgtgaatttgctgagatcgacgttaggccatttcgatgttagagcaccgatcagtaatctcgaaaaaatggacattattggtttcatatgatcgatgcacgcgatggcagggagaattacttgtcccccttcgaaaagtgaacacgtgagaggtgctatgctgccgtccacagtcacggtgtggacggcgtcgttactgaaggcgctcgtatcgaatctagctgccgcccgtagtcccaaagccgtgatatagtgagtgtggtcgcgcgattctgcgggacagctccaaaagcaggcgtctccgcgggcttcgaaagccgcggtcacgagctcttcgaacactgcacgcgatcgttcttggattgtccgtagggactcgtcggaatcgttgcatgcggaaatttcttctaaaagggcagacaaggctttcttaacttggcccgcaaacgcaggtcgggccggaaaccccacgaaatctgtttcccgcttagtttcgttccacagccagtaacaattggcattccacgatactgcatgagtgtataccccttccattcgaaactctaatctgatatcttcgggaaaccgtagcccgactgacgtggctaatttgttagcgctcttaccgcaagcgactcgtagtgtttctaaagcggtttctgttcctttagaggaatgcagaacgttgttggccccgtccgtgaatgtcccccacagtccatctttgacgtaggtacacggggcgaatccgagagccgacgcggtagcttctacctcgagactaatatgattcccgatacagataatagctctataaacatcttcacgcactcttttcaataggcctccgaactctatgatgggctgcttcaaccagtttttctcgcgctgcagtcgagcttttaccgcggcgcgcaaccgggaatgatcgggaaacagtcctagatatagagtcgcaaaaaaggcgctaaaatcaaactttgcgatatacgcttgctctatgaaagtcggttcccggaaaatacaagttatccgcccagccgtccagtcgtcggctacctgacgccgcgtactgcttgtgcgcccttttaaattttcgagtacgtctataccaggggtcggatgggtttccggatgccaaggagcaagcaggtggaaggttctcggtccggccagtggccacaggccatcggtctccgaatagctgccgacggcctttctgatggccgagggggccgccgtagatgttttcaagagcggccaaaggggaaatccgatagtgcaggcatagtcaacgtcctcgccgcgcggactggtttcggggccaatatatacaaatataggggccagccttttttccgagtcatcggctagagagtatatttttttgtgccactgcgcatagatggccaataatgccgtgagagaaaattcggcgggtgtcgtaaccaagcagtcaaaagacgtcggaaccggagccgcggtttttatgggtgcctgtgagtcgggtaatgatagaacgcgttcgacgatagtgaatattctattcgtatttccccatttgattttcttggacctgcgacccactgttttatattcgcggatgaaccggtcttcctttgtgtaaatttcgatacgggagtcgaattccgggatcgtgtcgtcgtgtttaagagccgacaatttaatgtgggctaggtgcgcgccctcagtatactccatagccgtggatacgaggcgtgattcttctacgtgcacggcaccgtccgtttttagtagccccggacggggagcacatcgatcgcccggcagaggttcgcacgatataactaatcccgttgttgtgtctacgtacatatcgacgggtgcgaagtatgcatgataaccgagcttaattctcaattttgccagcgtcacggcgagcagcgctttccatagagcgtgctggtccggcctgcaagacggccaaactcccgtcacagatccggcactggccataatcgccagtgccgcgtcggttactgaatccggattcaatccccaagctctcgcgatagaccgtcccgatacgtttaccgtagagtaatgtgcagaatacgtaccgcactcatttctaaaaagcaagtaacacagtgcggtaagaccatcggtgcggtctctactagtccatactctatacaaagtggtatagcaaatacacccccggattttctgtaccgccacagtattagcctcagccattgttgacataactaggttcgctgcgtacgccttacaaactgtgaaaatctatagcgccctctacacgaggccagcacgccgggggaacttctgccaaaaccgtctccaggtccaaaatgtcgtggtatatgcccaattccgcgtccaagcgagatttcactagcgcgtaccacttagggcgtcgaatctcgtagcgcgttttgcggaacgacgctttgtttttcataaggagtgtgtaaagcgcgcggtgcgttttgatcgacgttctatctatccccgccccatccaacaaagcttctatctccgcctttcggagattcttaactttggtgccacccggaaacgtcgtcgcgctctttacaaggcgtaacccatacagtatttcccatgtgactttaaaaacagaaaaggcgtggttctcctccgtctgccggcccaagggatacctcgcgagaccacttaacgcgcttttcgttgttttgactgatcgtttagaggcagtacgggcatccagcagataacatcgcgtgacttccaataccgaacgaataaaagtatcgtactcattttgcatcacacgcagcatcgataatggatctaaatttttagctgttccctctaaagggttaatacccaacgaggtcgcccatctgcagcataaccgatataagtgccaccttccagacacgttgaaatcggccgttattgcgacggtacccagccctccatcgggcccgattattggtaagctgcctgatgcgtaatactgataaatacgacagaacacctcttcactataaagagcggccggcgttgcgcgacacgcttccaacatcgtaatatttataaattgttctctagtaagcggttctgccagtttagttaataattgcgcaagatcgctcggcgatccgtcatgtcttagatatttatgaataaacggctccaccatctcattgtcgatcagatcagcctggatttgaccgcaggcaattttacggaggtgtttcaaatctcgttgagcgataagggcgtctgccgttaaatccgctaagaaggcgcagaaggtttcagcgtccaattgagagtcagatccgtcaaatctgacgcttattagattcgcgtcaagtaaggcgtggagaatattgatgctgtcgctaagattgttgagggtgcaccgttcaaacaaatgcttgtacttaaatcgtgggaaaatgtataacgcgtcggcggacttgaaagtcggaacgcaatctcttctgaaattgttacacaacatattggtcgcgcatacgaattgcgccggccatcctcccccactggcgatgacgtggtttagtagcatgggtgtgaaaactggctccgaacgagctcccgatgcatctatgtaaaccaagacttcgttacggcgtaacgatcggattctacctaaagattgatagaccgaaaccatatcgggcccgtttcgcgtcggcttaatatacgcgaacatgctgtggaagtgggagctgataaaacttaggcctactgttactacggtagtgtagatgacaactcggtaacgagtccatgaatttatatcaattggtatatcacgggtggaatttaagaccaggacagaatcggtaaatatgaggcagaagcgtgccgccgcttccgagaatgaaattgtcgaggaaaataagcaaatgttcaacccgcccgcgagtcttctgctgagttcagaaaaaaacgtcgtctcagtcacgcttctatgccgagagtgggtaccgtcagccccgtgtttaggtgtgggtcgtacatgaaaacaatctgattggtcgctattcatgacggagagaagtgtatctgttcccagattgcggaggatggtacatgatctcttagaaaacccaggggctgcgtattcgcccacgatgacatgtatgttatcttctcctctcatgcttgccaacatatctaccagttgtgtatttattgtagcgtccattgctatgatcctcgggcaattacgtaacagagtcgttagtatcgaatcgactctggacagatgcctcatggttggagagtaaagttgactaatggtcgacatgacttcgtccagtatgatgatttcataccgtccgagcaagtcagggtctatgcgatgcaaagattcgatttggatcaacagtctgtaaaactctctgcctcgtatgctgtagtcactagccgtcaaatagttgccgaaccccgacagcccggcattgctcagtttgtcgaataatgtgttcgtaaaacttcgcctacaggacacaaccaaaacgctcgtgtccggattatataaaatacgctgcaaccagtctatgagagcagttgtcttgccggatcccataggcgcgcgcactacaagtacattgcgcgctctcgaggacagtggcggcggaaaagtaacgggcccgtcggattggcgctcggtcgttactccgggtctgttcttagctatccaatctatgagaccttctccgtataatatcctcgacaaagaggcgctacagacatagtctatcattttctgtgcggtcgatgctctaacgtcgccgagaccggtgctccgggtgaggattacgttctgacgaccagagaaccgtctacgatcgtcgctatgtcaaaaggaccgcgatcggaaggagcccggagaggagcagatcatatagactacattcacaaaaagatgtgggttgtccaggcggcgtgtttttctgtcgccgtcttggttttcctaggaaccctgatagctgcatctataaacatgaccgaaggtttcccatgcttttttgcggccgtcgtggactacgggatgacgaacgtgacgcttgtgcatacgggcatgaccaatccgaggctgggaggcgtagttcctgtgctgtttttccaaaccaaagccgtggcgtttctcttctattcggcgagcgtcgtttttgtatgcatcacgtgttatatcgccgtaggcgccatcataactagcaagaaacgagtgggtgctgcgtataccggaaggggcgcgttcgtcctttcacttatggcatcgccctcgacaattttgttgggtactgtgtcgatttggcttcttcaagcggtagttatagtcctagcccacaaacttattgtactagccgcggcggtttatttagtgcacttctcgactataacgtttttttatgggtatttctgtggaaggggcgttgacagtaaagtatatgcggaagacatcgctgctgcgaaaaacgtagacgccggtctgcacagattaattggaaacgggcgggcggtcatgatcaacttggtttcgatcgtatacagtatgcttctgataatggcgtctctaatgttaggcatgttactagcaaacagctttaccttaaagttttggcatgtcatcgttaccgtcctcataacttcctcagtcttaaccctaatgtatcttttagtactcgagttcctagtggcgcggtacgtgcacatgattttgggtgcgtacataggccttctgatcgcctatgggatgctctggaccacctcatgtgattatgtcaaccggttctacttcgcgatgggcgtaggagccggcaacttacgcactgcctgtcacagcgtgctggcgtttttcaccgtactgattgtagcgggcatgattgttcgcctaatccgggccgggttgtatcaccgtaggcgatctactcgtgcatacgccaaagccaggcagttacaaagaaatgtaaaggagagattgagacgaatgagtcggggacgcgatcgtcccgatagccgagctgaggacgagcgggcgcttacgcaaacccaatatagcgaaacatcagacgacgagactatatatgatcgcgtttattcggggtctgatagtgaatgggatgaataggaacgcccgaaacataataaaacgctaaatctacaagtgattgtcgcgcgacttatttatcactataacgtatcgttacattgttcccgaccgtccttaaatctgaaaagcgtctttcctctcgcgcaagtacttccagctaagacagtatcggaatggataagagggtcggaggacctaagaccgtccaaatcgacggtatcgtattgctcgtcgtcgagctcaattacatgtcccgttttggtcagaacggtgtttcgtttccgacagcgtcggaacagttccgttacggatattgcttggcccatacttgctgcacgagttcaccgaacgcacggtatccggcctcttctacttcaccgtagaatgtaacgtccacgaccacgggagtgatgaggaggagaacgggaatcgcttgttcggggtctattttgacgcttggagtgggttctccagtgtttccttcggagatcgtcaggcgtctacctaattcgccaggtcgtctgcggcggcctataaacgtggcgaggtgtgggatgaccgggttgctttcaaagtaattagaagctacgtagttctgaacgaaaatctgcttgaaatttggatgtcgtgggttggcaaatatgggcacaaggacagattgttctccggtactccagcatagcgggtgtatcgcgttcgtttgcagatcaggttcgccaaacagccatacgcgagaactgcagttcttattggaggccaagtgacgcgaatcaaagtcgttccgtttaatgtttgatgaaatggcgcggaagcgtgatagccccactttccagtcgtcgtcacatgtgattagcgcctcctttgccttaggaaaatcgtcaggtttaaaatagtccacgcaaggatgattgatggcgtataagaatcttcggagcgctgcgacggttcttgtttgtaataggcgttcgtaacattgagatagctcgcttcgacattccgggtaaaacgcgtatttggccctacactttatttcgtacgtttctatggagtggtcggggagggcaggcgtaaggattccgcgtgcgctgcgagggcataccgccatatcgagggatgctccgagcatcccggttctggcgtctatcatcagaccgcacgcgtatttgtcagaggcggatgagacggtgattgtctcgtccggtacgcgtgcattttcgagcacccgagaaggttcgcgaggcctgtacctggggttctccagacaataggtctctatgagcgctctcgcgagcggctcgttacgcgttccgaagactacgctttcgggcattccttgcgccgtgatttcggcaggtcttatgccaacggtgtttatccgtccatcggcggtccacttcaatgtcgatgcggtcaacagccattgtctaagtacgtgccatagctcgcagtccgcttgcggtctggtgagagtttctacaattttacaccagaaaagcgcatgattagacggcgacgttgcatttgcgcccgattcatacaggagcttgtcttccgcctctaggagagaagaatatgaagatgccggccaacgtccctctgaaatgcctcgtttgataacgtccgttatgtacaataagcggtgatacagcgggtgtggcgagggccccgattgcttcgggtcgacattccgtaatatatagtcgctgaaggtataatcgaccacaacactgtagcatacggtatcgtaaggtttggactgcactgcttctgcgtgctcggcgcaagcgaagacctttggacacgatttaaattcggactcctttttacgtttccgtggcccgttctcgccgagacggaacattgcggtggagtctatttccataacagccgtgtagcggccctcgcttctgagttcgagtgacagtaaagtgcaacgagctcgaaaagattgcttaaatatggcgggactctcaatgaatcaaatagcttcctgtgcgtcacttcatatccttctaaatatttctcaaacgcgaccctgtggtgagagccgtgtagctgcgaacgaatcttttcggctcgttcccacgggataccgattttggcagttaacggggtagctggaaataagtactggtacagcatacaccgatacgctaacatgtctaaaagatagtcggccggcatcattttatggtaataaaaatgcaccgggtttccggggatggcaaagtcccgcgtaaaattcatcccggcggctagaagcacttccatcagtgattggcccagtgcgtacatatctatagcgacaccttcatcactggacagttgacttgaaccccgctccaagcccgtcccgtttaaggctttaaccagcaattcgcagggctgcgtttgcccatgccccagcactaaatcaaatacaggtctaatgtttgctctagacacttttactgaatatactcgatcggagtctacagttatgtcgaatcgggctttcgtaatggtggagtttgtgttaagtaacgccaagctaaaatcgccgattacggcctccactataatagggttagacccttccctgacgttgacgaaaatgttcccgcacttaatatccaaatgagtcagtccgcaggacacgttcaagtacacaacggctctgccgaggcccatgaacgctttttctatggccctccaatggcgtgcagttttatccatcttcctcagtcgatggcagtacgagtccatgtccatgtcatacgctggaaataccagttccctggatggtatcgaaaaggccagtaatgaaatcacgctattgagcgctagagttgaccttgcccgacaagcgcattcgccggctatcagtgtcataagcaattcggtcttgaaacactcgaacacctttttgacggctacatttgcacccttaaatactttaacttctccatagctcccgcttcccgcatatattggcgtttcttgcaggtcgatggtgctgtaatgtaagcccggggagatatcgaaaatgagcgatgttatattctttatgcgagatagagtgaaaatatgatccggcaaagatggtcttgatagcaaaatgtcagatgttttcctagatatatgtttgcgtctcctatagaattgttttaggcatctcctaatgttgacggagatgtgttgtttgtggtccttttttctacacgaatctcttcggggggcactgaatgttccctgcagatcgtctgttgtgcttgagtatcccttaggcccgctgaagtcttcttggtcgctgatgtcggaaagccatttaacgtgaggacactcgtcgttttcgcggccgcgccccggctttctggctttgaggtcaagatccattttgacagcagcgcctcgcactctgcgtccaattctatgtctggaaggcgatcgctgatgtcgtcgctgatttgcgttaagatgtcttcgtttgctagaatgtcctcttcggcacgatccaactgtgactggagcctagggtttaaaaaccttcggttcgcatctaagacgatgcggcggtccacctgttcgtctatgtggcgttggataattctcgactttctatgagcttcttcgatccgcatgttcgagtgcaactgggttttgtagtcactgtgggcgtttctggctgacgttaacgcttcgatgagttctgggtcgtccgcttctacaccttgggacaaaagtgtcaaggtgcgttccttataaattttctcccgcgttcgacactcggccaatatttgacgcctgcgtctgcgtattgtgttaacggcgaacatcgctcgacgagattcgtagtctggcgattaccgactccgtaaagatgttcggaggcgcgctcggagaatcggcgaagaagcactttgaacgcctgctgagagataggaacgagcgtttaggtgcgagccgtaaaaatgaatgcctcgcgcgcggcgggagtttagtcgacgccccctttctaaattttgcgatttcggtcccaaggcgacatcagacagtgatgcccgctgtcggtacattgcatgactgctgcgacggtactggtatttactccgcgatcgctacacgcctgctgtatgctggtatcgtaagcagcgaatttggtgaagtgcgacgcgagtcgttatctaacggtcacatatcgaaaaggaatcgggaggcgttgcttgcgccgactctgacacgcgtcgccaattccataacatttcacgagtacgacgatgcacaatgcgcggcgcatcgcaacgcgtattacagtacgatgaacactttcgggtctatgaggacatctgacgcgtttcaacagctggcgtcctttatcgatcgattttcaaaattattagctgcctcgtttaaagacgtgaatattttggacagaaataacgctcccaaacgagcacgaataaccgctccctcgtacgataagcctcatggcacgctggagctgtttcagaaaatgatactgatgcacgccacttatttcttaacgtccgttttacttgaagaccacgcggaacgtgctgaacgtttgctccgtgtcatatttgatatcccagacttttcggacgcggccactagacatttccgacaaagggcgactgtttttctagttcctaggagacatgggaaaacttggtttttggtgcccttgatagcactggccatgtcgtcttttgaaggtatccgtattggatacacgtcacatattcggaaagcgatagaacccgtttttgaagaaattggggatcgtctcagacgctggtttggtactcagtgtgtggatcacgttaaaggagaaaccataacgttttcgtttcctagcggatcgagaagtacggtaacgtttgcctccagccataatacaaacgtgagtattgcattcaaaaccgttgtgtcggatggtcccccccctatacacacacccgtgatagtctaatacacccttgaaccagtatcgaactccacatctccggcaggtagaccaaatgccatccgcatgaatttacgggaatcttcctactgtctacctcggcttcgattaactcttcgagccgttctgtaatgcacgccttcgtgccgctattaccgaccactcggacggcatttaccgtgtccatgaataaaacgcaacagaggcttttttcccctttgacttgtatatctgtctgtcgggctttcatccacatacacggacctctgcaaacacaagcctgcccgagcgatccgcactcccatctcacgttacaaacatccacgtgaaggtcgaaatgcccacggcattccgcacagccgctccggtggttaagaaattttgctagagtagcgcccagagaacgttgctgccaaccggcgggacatatagatagcaaactctcttccatcctgaggtaataaaacctgcgtttggaaagggaccaccaagctccaatagatatcgctatacagttgtgtggatcgtctggcggctgcgtgcgttggactagggaatttatgtccggtgcgatacaagagatagttgacaaaggttctatggcgacgtccggaagaccgatacaggtcctactaggagcgacgtcagaaaagaaaataagatctgcggaagatccgtcgcgcagaatgggggttatgcgtaaagcggcagtcacggaataggcgcgcgtcccgttgactaagaacaagagttgaaaagtgtttctgtccaagtacatctcctttggtcgcgtaaggtacatgaatatctccacccatttcgtcttttgcggccgagcgcccagcggtacgtacgtacataacgtaaagtctaacgtggttaatgcgaccaacacagctagacgcgattcggcccgaagcgtgcgccatacgcaaatgcggtcatttaacttattaacgaactcaactgccgccgtatcgcaagtccgttctgaacgacgcggcgatccgggcgtccttcgtcttcgcgtagtcatcgtcccacatctgtatgacgctaccgctaattgaatattcgagtcttggcagggcgctcatggaaaagataatgtagtgttgctgctgcagaggcgcgataaaaccgcgtccgcccgcgccagaggccaattgaactcggcgccggcatgcgctgctaacatgaaccccgcgggcaacacgattgcaacgcgcatacgttcatcataacctacgcaaatatacgcataactttctccaggaagaaatctttcacacgttgcgcgcgatacgaaccattcggggaatgcgcaggttctaatagattcgtcgcccggcccgccgggcgacaaatgcgctgcgtcacgcaaaataactgggataggcctcttatttaacatcatacattctccgcccgcgctataataatcaaataggaaaagattcggcgtcctagtagcgacgggttggtagtcgcctcccaggacttcggcattgtttccagtcgtatgtatgtaatatgtttttcctccagtgcgcttaacatgcctggccagaaacgagatgctcgcggacctaagagcgcctactgaaaacttctcaggcgaagaactcgcgattgcctgtagaactgcgcgtactgaatggggtgtgcggcttgcgatttctgccacgcactgaacgtctcgcgcatacacgtcgtagctgatcagctgatatagattgggccctgttttcaacgcttccccaactgcccttatgacacacgcagagacatacgacttgaaattaatcattaattcggtttcggagcccggagaaaacgcacgcagttggttttcctctgcttttaataagggagcagccaaaataggagcttccgttgcgatttcggtctttcttctttgtggtagacgagaggggtgatcgacgccttcttccatacaagcggtagcgagtaaattgctcaacgaagatggaattgtggcagaatcggaggaacggccccctaaggcaatcgaccgctcatacgatataagataaagtgtttttttggtcatggagtgggtacgtggaacgatggatatgcccccgcacctccaccggttcgcaattgtgagcccgtccgccaaaatgccgaccgcagaagataggaggtctttggggcttaacgaattttgcgatggttcatcgaacatgagaatgtcttccaaattcaatgcagtccctgtagattgctggtccttattacggccctccaagcccctccgagtgtcgtggtttctggcaaaccttcctttgcccacgggctcgagaccatctatgacggctttctgtgacacgctgctactgggtgtgcacaaattattttccaaacaagctatcgccccttggcgcaatccggacactacgctggcgtgtatattctccgccggccgttttgcgcttaccggcgctcgcctggtgatagcctcggctgccttcttaatgagatttgcgatctctatattgtctgtctctagtcgcgtgtcgagagtaggagtgtcgaagacgttcggagaatctgttacttgccgcataatgtcaaactgaccgggcagttcgacggcggataaacacgcctctaatttagcccccaattctataacagccgacggtaattcgacctcgtatctcttagtatatcgtatgaattgacggaagagcgtctttaagcggttcgcatcgatatcgtatcgagtacctggaggaactaattcctcttgactaaacagtaaatccatgtacgcttcgtactctccggtttccctatcctgtacgttaaagcgaatagccacggatgtaaacggatcaaagcggttcttagaatcatattgtatgggaagactcatgaacaatccaccttgatcgtttcgattgagcgtcgcgaaaagtttggcgtggcccgggacatgaggtatcaagagtatgtgtagtgcgccagagggaacgtaggctgccggtgattcgcgccaaccggaacatttaccggtggcattatagcgcatctgaacacttaccggaatcggcagcgattggtaagcactgctgggtactctctgtgccgcatccttaaaacgggcgatatctatccccgctgccgacaaacactcatccggtaagaggacatgcgtcagtacgtgccgattggggccgtgtttgggagtagatagcgaatacgcggtctcgctctctatatgcgcctccatcctgcaccggaatggcgagtcgggtcctgcggtctagatagcgtcgcgtcgccgttaatgcgaggggctatgcctttacggaccctctcgactcagcattgcttgtttttgtttctgcagagcattcgcggccaagatttcaacttgctctttgtcgacgaggcgaatttcatacgtccggatgccgtgcagacaataatagggtttctgaatcaagcgaattgcaaaataattttcgtgtcgtctacgaacagcggtaaggcgagcacgagtttcttatacggtctgaagggatcggccgacgatctcctaaacgtggtgacgtatatatgcgacgaacacatgaaacatgtgacgaattatactaacgctacgtcatgttcgtgctatgttctgaacaagcccgtgttcattacgatggatggggccatgcgtcgcacggctgaaatgtttctccccgactcttttatgaaggaaataatagggggtatcaccatggatagaaacacgtgccagggagaccggggggtttttactgcttctgctgttgagcggcttcttctatataggccgtcgactgtacggaatcaggatatcctctcgcgagacttatacgtgtatgtcgatccggcgtttactgccaacaccagagcctccggaacggggatagccgtaatcggtaggtatggagcagattacatcattttcggccttgagcactttttcttgcgggccctgacgggagagtccgcggatgccataggagagtgtgccgcgcagtgtatcgcgcaaatctgcgcgatacactgcgagcgtttcggaacgataagagtggccgtggaagggaatagcaaccaagattcagcggtagcaatagctactagaatttcgatcgacctggcctcgtacgtgcagtccggagtggcaccggcgccacacgacgtttgtttttaccacagcaagcctgccggcagcaacgtcgaatatccctttttcctcttacagcgccagaaaactgcggcgtttgatttttttatcgcccgcttcaactcgggtcgagtactagcttctcaagatttggtttctaccacgattagcctgtccaccgatccggtcgagtatttgaccaaacaattgacgaacctctcggaggtggtcaccggcgcgacaggcacaagaacgttctctggcaaaaaagggggctacgacgataccgttgtggccttggtaatggcggtatatatatctgcccacgcgtcggacgcgacgttcgctcctataagaggagtcgaggccacgtgtcgcggcccaacagaagcgtgaccggccccgaagcgtgaaatatatctgccgcgtcgcaggaaaagctaaccaataagcagactcgcataagcacaaaccgtttattagaaggctacccgatgaataaagttattttaattccagttagaaataacgggacataggtctccgacttttatactcgcgggcccgtcgaacgtgcacactttcaatagcgggcgcagcgctagcatgtcccctagatgcagagccatggtaatccacgaagacagggcttcgtaaatgggatatctgcgccacgcgtcttgcaaaggcgggggtctcggaattctgatgagctgacctactgctctcgtggccgtctggagacccaccagggcgttgacgtaaccgtcagacgctcccaaagtaagcaacgtcggtatcagagcatataggagcatgttaccttcgtcgatagcgaaaatcatgtttagcaataaggttctcactgcagactccgacgcatccagactatggagcgtcggactaatggtataggttttcccgttatatgtaatggattccgcttcacggctcgtagggggaggcgctagccctccgccgatcgctatcccttccgtggctcgagatagcgtcttagcaataatttcacgtgcgagtctcgccggaacggttgatggaaataaaagttcggtatcgatcgattccaaccggatacgggagcaaacgttagggaaaagcggaggtatcaggcatacagcatccccgttacataggtcgaacgggccggtgttttgaagtgccaggcctgaaggaatggtccccattcccaaaactacagcactcattcgaccgggtagcgcgcgggtgacgacggccgcaaatcgtcgtttgtaggtcgatagcagactcagcgtatcaggttcggccccagcgatgtagtatgacttataatctacttctttgagcagcactctggctctgacggacggtaaaaaaagaactcgcccctcacatcgttgaagtaggttcgcgtcgcacgtagaaagcccgcaggggagctcgatctctactgtcgtaccattagaagcggccataacggtaccgctggcggtttattttcggtaccgacggcggcagcggataagtgtataggaaccaggccgagccgctgtcaggtcaagcacgtagaccgcggaaggttagcgatcggcgagctggcagttcagcatgcaggcaagcatccaccgatcggcgaagcgtctttgattaagtattgagccaagtgcgtttctgggttatccgcaccccctgcgaaatacgtgcggagcaaagctttgtcggtagcgcaaagtagcggataggcttcctgaaatagggaacaaggatcttcgattaattccgtagatccgactggtcgtttgaactgtacttctccgtccgacgcgaatgctgccacggcagaaccggcttcgctgattagtttatccaagcaccggcttttgcagcacacttctgccggggtaaaaaatttataggtgggactgaagaggggagacgccccgctcaaattgtaagttccgttatagagcttgtccgcgtaagagaatttttgcgaagcccacggattgttggttgcgcggaacggataagcgggatccccctgccggtgatcgtacatgagtttctcgatatcggatacttcctcgtccgaatgtatcgccccggccgccctccctctcgggttacacggggttcgaaagtactccaggtctgcggaaacgggtgtagggatgaactcgcatatggacatttggccatgttccagcccgtcggggagcatgggcatcagtgtacctagaaaggggacagttctttgcggagctgttctctgtccgcgcgttgctgctttccgtagaaagtcatcggcttcggggtttataagggggggcgagccccgtgtcaaatgcaggctttggacagtgttccccatatccgtcgtagcgtttcgtaagagtaaaggggtacaagtggccgtataccccacgcccaaatcaacgttagctcgtggttgtgtcagagaaaactgcaccccccctgcgtgcgggcgcttcgagacagacacctgtccgagaaaaaacgattcggacgcccgttcggcaaacaggcccatatctgctaggaacctatcttgtcgtacgacggtaaatgcaattcccggatggaaccccgttctcaactgatgatacaggcctataggagtgagtttgaaatatcctgccatcagcgcgtacgacatttcgttgggcccgcatctactttcgcatatgtactgtgccacgggctggcggaacgtagaataataattggcgcccaaaaactgtggaacgggaggagctctgccgagcagcgtacgcgcgttcccggccaactccccgactgccgttagatggtcctgacaggcgaacaaagcgttaactggaacgggatagaagtacgtgccggcagcgatcgtctcatcattgcatgggtaggccatcattaaaagcccatggtgtaacgcgccatcgaacgttcgcatatgccttgtcgccgatgacgtgccgcctacatccggggtggttccgtagagaatcgccgttgtccgctccgccatattgttcaccgtttcctgcagagttagaagcgcgtccgcatccaccaatattctggcgttgtgtagcagcacgttaaacgtgttggggacaagatttctagcgttcaacgggtgcctcgggtcttctgcgcccaggggaggctcctcgtcgggttggatgtcgggaatgatcacagattgagacgtagcgtagatgttgtcgaaacggatgcccatggtgcaacactgacccctggaaaatgccgggaccatcacgtaataataaattttcgataggattgaccattcatgggtatgatgaggcgcgaacgtttgtcgatcggcgtctcctacaggcctgttatggactaaaacgttgccggtgcgttcaaaatccgcatcctgcaattccagccacggccgcacagcgtaattttcgtcgcttcccacgttcaaatacaagtttctatcgcgcacgccgtgcgcttgatacatcagggggtcacagtcccacagtagggggggtaggatcgctctatcgattaaggcgtggtttaattcctcattactctgcccggtcagtgagtctgtctgaacggtataatcctttacaatcgaccgcagcgcgcgaacgtgccgcatcagctctttgtagatattcgtacagtcctcagggagttcaccgctgcataaataggtatcgatgaatgcgaccatgtgaaagttattgacgaatgctactcgtttgcagttgtcccagtaactccgtatacattgaatgatcagtcgcatcagtataccgaaattacgttcgctgccgtgaattacggcttcgattacataaaacgcagtggggtagctaacgtctgagaacgttgcacatacggcattgattgtggaagcgctcattttgtggcgactggatgcgagctcttggccgagcgcatctctaaagtcgctactgcagagaggtagcggaatattacagttgcaaacccgccaggaggcggcgatcgacgccatcacttgcggaacgttatgcggccccgggagctctacatctcccgggaccacaaaaaagtcaaacgcgggatgcaactccatagatagatgtggatttccggccgataggaattgctcttgactcatatggcattcatctacccaccggggcgacccgcagagcacgtctccgatgttctcgaaaaaccgacggctagcttcccgtagaggcaaggccggcgggttcgtcacatacgccccgaaaacacacgttaaatcgcgtctgtcgcgacgtaaatgactaaccgtcgcttcgatatccaaaaaggatgagtggcacacggttccaatagcatccgataaacatacgctaattatctggttgtctttgttatggaaatatagctcccgtggcgggaacccgcgcacatctccttgacatccaggcccgggcgcatagtccccaatatgccgcgcataacggtccgcccgtttctgatatagtcccaaaggcatcacgaacgttaaatctatgtgtccgattaaagggtactggacttgcgttgcttgataaacgcgccgttccatggcttctagaaaaattaacttatccccaatggtcaccaattccgcaggcacttctgccgtttgggggacatcgtcgtctccccgtacgacttcatctgtacgatcgatgatgtcgttttcgtcgagattgagaatatagcgtgcgatgtcgtccatgttgcgtatggctttgcccatcactacggcggttactaggtttgttcccgatattatcatttctccatatgtaacgggcaccctagcagacgtatccgccatgtctagaattcctgatagcagtttttgcctcaccatgctcgttgttactagtacgccatctacgaggcgccctttcgaatcggaatgggtcagcctcggcattgcaattgtctgatgagtagagttaaccatcttggcgaggaatgagactatactgtctttgctcgcaccggctttgctcatgatgaaggtatcgttacacactctgcgtttgagctctgataccaaattcgctcgcattacctgcccgtttacccttccttctgtcgtgctgcgcgaaaggggtatcagtagcggagtcggcggagccttttccatcagtattctaagcatctgatcgaccgtgccccgctcaaacgaatccaatatcgttctcacgtttcgagctaattgctgtatggctctcagtctcaggtggttagatattgccgttccatctaaagatacttcagataataatgcgagtgcttccgccgcaacgacaaaggccgcgcttaacgatcgcttgcatacgcgctttaccatgtaagtgtaaagcggttgatcggcaggatggggcccctcgcgcgcaatcatgggttgctgtatttcaaattgcacggttccttcgcgcatgtatagcagatcgggagcacgcgtgcagacgcatgcgactgagagccccgtttcgagaaatctgatcaaagacaatgtattgcagtaggttccgagaagaatatcgaactgggccgaatagcgtccgttgtcatcggaactgaattgtttgaaatagtcgaacatgcatcgatgggatgtcatttctatagcagtcaggagtctacctgtaggcgctaacgttgctcctacgttgaatggtgtcgaaattgcacacggtgcgattggcggacagtcggtcgccggaggacagcggcatccggccatggtcgtcaacgggccgcgtccgatgtaaggactaattgccaccgtgactatccgatgctatgcgtgatccagggcatctagtaacgtttggtcgcgtcgaaggtcacgttaccggctgttcgaatgcgacgcaaatgatagccgatattgtaggagagacgtgacgtggagaatgcgcgagttctagcaacacgaacgaaattgcatattagactttaacgatgcaggtttttatctacacaatgaagtcgcgagtgcgcgtgcccttatatgtgcaagtttccgcccctaatcagaacggaacgcacgtctttatcagtgctcgtgtccacaaacgagggaggagaaatcccagtgcgtccgacacagctactgtagcgtaggtgatggtagctcccattaacaggtataccacagctccgtctgtcttatcgttttcctctaattgtaaaactttctccatgaatctcggatcttgaaacaccatgcggtaagaaaatactccgaatatcaccgcccccaacgtagacagaataccaacgaagatttgctggcagttatccataggcatgacatcattctttatgtttctgtacatgtaataagtttcgaggagtaaggtaccatagaacactgcggtaatggtcgcgcccaggatcagaaaacgattgtcgtgcccgtccatcgcgtacaccagaaatataatacaacacgagggtcggagaacaaatgcagatagccaagagagcacaacataccgagtaaatttggggttcatgtcacagcttttcgaaatagtgaaaattgaacctgataagtaagaggacatcgtggcatactcggccgcatcttcgcaatcgatatcgtccgaaacgcgtgtaactattgactccgtgtcttgcatattcgtctctaactgttcatcgccaatatagtcgaggagaatatcgcaatcggtcggttttgttgtatggtatccacgcctgtaccaaggcatagtgccactcgagaaggaccgtttctggccacacgtaacgactttgtcttctactaaagaccacccggactcggtacagacccaagctagagctcgagaccgcggaaaatggatatcaaatacgaacagaagatcttgtatagaaacgtccacttttatatctcggaatgcggccgcatagcttatttcttctgcggtggttgtctcatggcggtcgggcgaccgcctaccgatgactcgcaggcagagtttgcaaaatttgggctggctcttcgaggcgatggagagtctaaacccttggcagcttatgtacggcgggaattgcttcgtagaggaatgaaatgggcgctgcctcccggcgacgatgaattattcatcgactgtatggcctttttgaatctagacggggcgtgcagtgaacgtgagatttgcgatcttgtttgcctggaaacgtatgatccggagatcacaaaacacatggtatccacgaacgtcatttctggattgttgatccagacggcgcatgagtcgccgcgggactgcgtgatccacctgcccggggccccacaagttacagacgcacattccaatgctgtgtacgaatgtaattctggtgcattcgtgctaacttgcgcaactttggtggaactgcccacgtctctgaacgatctcgtcgaagggttgtttgacggtgtccccatccccagagatgcgctctcgtcgaggtcgcttagtagacgaacgaacgtgattatcacgtctaccaaagccgcggaaacgacgactatacagcggatgcatgtcccgcgacataaacagaggggcaacttaaacaccatcgcagctactttgcgaccggtgaaaaaacacgcgcggtttagcccgttcgtgcaagtaaagtatatacctcgcgtactcaaaatatggagttgtgattcagatagccattcgccgtccctaaaggagttgcgggaattgttttgtaaagtggacatggtccgtagagaaaacatgtacgcagaatcgcaattggaaccagagtccgtcacaagtgaactggttctgatagtcgatactgtatttgggagaccgctcgcaccatttattggcgtcgggtcggaaaacatacgcgtctcacatttccaaaagttcttactgctccagggcgtccttatattaaatcgtttgccgaattgctacggaccgcttcgggagctgtgcattcagcatgcacctgccggtgaagagtcgcctcctctggtatccgactctgttatcgcagacatggcgaaccatatgtttagggtcgccgtatttattggcatggttgtggaaatagttgcgggatgtgtatcttttgcatcagaagaactcgaaacgcgatttcccagtgcgaccgcgtttacggatgctggcattctactgaacggcatagaagcctcgccgaagccaaattgcttgtcggaacttaaaacacgcaaactcgctcttatcctggacggtatttatagagacatggatcctatagacgttgctctacaggaatcggtggggctaaatacagcagagttattatccgcagcaatagatatctcggttatgtctgcatttgagcattcgggatggtgtagcggctacatggaacactttgtttcattgctagatgcccgtctgagagagggagggtgcttggcaatattccggtagctttgtagcacagcggcgagacgcgcataggcgtgccgggcatatacagaacgtaagccaagctggagtttgtgtaagtatgtgctctacagcgtgcgggaagggcggttcgcgaataaacacaacagtacaggttcgacggttagaaagtttccagagtttattaattagattggcccctcaagatcgtctttgcgtcttaatttctcatatccatggtacctaaagttgctgacaagcattttggcggtgacaatcgctatagctgcggctattagtacacccgctgcagtagttgcgatgtaggtcgccgagaggatggcaatgcgctgcgactcaaacgctaggatcctcacgactgtgccatttggatacagcaatagtgacgtgccatacaggttactggtggtggggttgaaatagcgcacggacgaattgcctgctgctagcaattcccgctgcaaatcgcgcgatgagatataaatcgcatgtcgaacgtggccgcttgcggaatatcgcagcagcacgcagccgcaatacggacattcttttcccagaggcctaggtaaaaccgcaggactgattatacctgatgtcgacgtgcacggcagcctggcatatgttatgtaaagttggttgtttacatcaacgccgtctacggtatacacgatccctctgaccccggcccgccttgttacaatgtagctacctataccggagatgggtaacaccagaagagtgtcggattctaacctatcagtgcccgaacattccaaaacctccgacgcgtatgtagcaactgttctccctattgatgttcgcagctttgcaattactgattccgccttggcctgcagatcttcttcgattctgaccccctgagaagtattctctaaatactcctctattactggacggtaaaccacattggccatcgcgtataccctgtgacgccgctcggaaatgtcgatcctcaatgatgtcatgcacggcgtatacgcgtccaaaatatgtacgggctcagtgctgcgagtgagtctgatatacatgtcttgcaccgttaattcagcggccgcgatgtgttcttcagtacacatcgatgatgcaaataacagagatttgcgtgcgttatgcgatgcgcgccattccatcggcgaccgctgaaaaacgctgtcgaatgcataatacagggcgtgtctcgtggaagcattccacgagatcgcgtccctgacggattcttcgtggagagacgtgataaaatttagtgcgaggtcggaaattcgcgccccccattcgcccttctcccgaggtatgtcgaacgcgtacacggaccggaataggtacaactgtcgcgcaatacctaaagaatgcgtccccctcgatacatcgctaattttttttttcaatacggatgttagtatagcagctttttcattccatacatgtgtccgcgataataagaagcacgtgccggggtccgtgctcggggcaaaattgcaaagtgccgcggcgattactttcagatctgcctcccttttaattaattcatcgagggagacgtagccagacttaaaagcggcgtgtacggacgcaacaagcgccagaaacaaacgcgtcgttacgatcctaaagccgtggatataattactagtagatgcgggcatagaggcagaaataaaaagccgggagtgcgcttgagtgatatgaagattataatctaataggtcatctacactcgaaaccatatctgcgtgggcctttaattccatatccgaggcgttctgatatgttcccagtaggtatgtcgaaaggagatgtcgagaggatccgttcatcgggtcatactgcttcatcggtggccacagcaaagtcatgttggtagtccccgacgataatattagttccacaggcgatgcggcttccatagagatcgtaacggaggcgaattgcactcctaccttcattaagacctccgcggtatttgaaccgaatatcgtcgtccgcacgtgggcataatctgtcgggactagtgtgtccatggggtccacgaagcatgcacgctttgcaaaagctcccgataattcgctgttgagaataaaacggttctccggagtgaagaagtcattcggctttatattttctaacactgttggcgggtttgcgccagtaggttgtgacttggcaccaccgtgagcttttggaccgggtttgtccggtgtctttttttcgtctcgtcgatgggataatacggctgccgtcaacgagtaatcgaggtccggcttcgcgttcaaaactttgatcaggttattagacgttagcagcctagatatcggtcgtttgaagaaaaccatttgcttcacttcacttattggtaaatgaaagagaatgccgctcgccggcgtagatgctcctatatatacaaatgtcgcattgtcgcgtacccaggacgtcgggctagtagcattttcatcggccgatgaaaagtccaattttacggacggcggtctccggatgtctagcagcgaccatacggaggggatattatccgaggtgggggctcccggggaagatgcgagcgctagcagtaataaggtgcataccgccattccgattacgcggcgtcggtcgttgcctctgcgtatcgctagttcgagctcgggtttccgaagcaacgtaacacacatatcctatagtgtacaatgtttcgatgcaactgaaagcaacgagctaaagcgaagatgttttgcaggcgacaagggcatgcattaatgcacactcgtccgaaatgtcgtagtctcaaatgtccatctccttattgaatgcctgaacgtccgcctcgatctcaaatacatcattccagctcatatgcgttattaatctttccgccattgaatccataagatactctgcacatttctggaccgacatgtcgctgacatcaagccgctcgacattgatgttcctcagtttcatcaacatcccccacaatatccacccgtataccgttaacaggctaccatcttcactgcataattctttccgcttaaaaattggcaaaagcgtgtgctgcaatgacacccggctaccatggtaacctgaacggggaccatctataaatgtagaggccatcgatgcatcaaaccacgggagctgcatccactctgtttcccattcgtctttactgtaaggacaaatgcaattcgcatacgcgacggtatctgctaaagccgaatatgccgcattgagcgccctgagcatgcgcacgtctgtagtttcccccgctctgttcctggccgataggcgcttcaggtgctcggtttcgtcgggcaaatgtgctattaccaagttgcagccgggcggttcgtggggcaaccgtgtaatcgcactaatcaacatttccagagaacaatcgccaatcagatgtcgggcgatgggaaagcagacggtagctgaaacaggatggcgatcaactattaatataagagatgggttgccccgtgttccggctaattgatgacatttagatgatattcgttcgtgtagtacaatgaagggatcggcaaatttggcctgcaaagccattacgatcatgctagactgaaatagagataattctccccgacgccggcgttcggaagcgtcattcacagctgcaactaaatcggtaaaatagcgacgccaatatttcagaggctcaaaaactttcagcacgggtactcccgtcgcagagtggctcggcacttcgtttaacatcgacgttttacctatagccaatggcccgtcgaggtagacgcggatcagctgcgcggatgtcatctgagagggcattaccgaccacggccgcacgtccgacatgtccggcgcgcaagaaaactgctcgtagacgatataaccggcggagaagcacttctggacgctcaagttaccgtgcggctgttaacctcaagagaactctagcggccggcgttcgatgtcacgcacgtttttaccaaaagctctacgcagaatctatgcaccttcgaactcaggccgatgattggacggggcgggccctatctaagattttaggaaaaattatggggtttgatgtatttaaagcggcaactgatttccgattggtctttgaagtaaatctggggcggcgaaaaccggactgcatttgcatgattaggtgcccccgcggtctatgggaggcaagttgtgatggcgcttgcgtcatcattgagttgaagacttgtaggttctccaataatctaggaacggccagcaaaaaggaacagcgcctcactggaacaaaacagctcttggattcaaaattgctgattgactatttagcgcccgtaggttcggagcgtattttcatctgcccgttactagtattcgtgtccaggagaaaattaaacgtgttgcgtgtaacctgcctcagaagaaacgtcgtaagtaccgatttccatcgtctcgcaactttaataacgcttgcatcggaatataagattaaacaggtcgacaggcgcagaacggctgttcggaaaccggctcagtgtgcaagaaatttcgcaagtcttgagaacgcgcggcgagacgatcgatcggaagaggtcgagatacacacttttcctaactgtagtattgtcctaccacctcgtaccattctacccggagccgcgaatacgacaatgcaccgtttggcaagtattgttagctgcttggtacggaagcagtaaccgaaatcaacggcaccctacgaccagctatgttacacggtgcaatccgcggcccttctcccgttactttcttgctccgcagcccttgtccaacgtcagttgtccgtaggcactgcagcaaagcatggcgagctttgcctgggatgcaagaattttgacagacccgggcccggaatctcacccggctgatgtaaagaatttcatagcacctccctggcctctgcacttctggagggaacctatatttagcggcaatcttggggatgcggaacggcaactggcaatcgttaaggcgcgaaacagtgccgcgattgcagcgttaactagtttggacgaccgtactgatttaattgcggtagaagtggagcgtcggcttcgaccactagaagataaaatggaacagatcgcaacgactttggcggatttggaacgagctgcttctgcggctgaacttgccgacgccgcagccgatgaggctcaaaatgtcgtcgattcgaacgaatgccaaaaaaacattggtagcgctgcgagtcgcgaggtccaaatagtcaggaacgatccgtcgctaagatacgactctaacctgtcggtggatctgctgaatattatctatgccagcaggggcgctgcgaattcgggagtggcgttcggtacatggtaccgtactttacaaaactcccttattgcggaaaatcccagcgctgcgcggaagatagattatcgcgatggaagaatgtcgcggaccttcattgcaacggcgataacgtccttacagtcatgtgggcgcttatatgtggggacgcgtaactattcttctttagaatctgcagttctatgtctgtatgcgttttatacaaaaacgggagctaatgtgtcccatccaagttcttttaagagtgcattagaatctgttcccatttatctggatcacatgtcagcgagcctcgctagcactgataccaggcaaatctacgggttcgataccgggaaattgccgaaggatagtttcgccgccccgtccggaaaatacgaacggggcgcgctaagtgatcatagcgtattgagagctctagcaaattctcgcgtgttgcctcctagtgcggggtcgatcccccgtggagacgtagccccagagctagatgccgaccagagcgttcgtaacgacgaagtcaacgctgccgccgcagcgctactgggacgagcccaacccctcttccttatggaggatcagacgttgctgagagccactttggacacaatcgtggcattgcttttacttcgccgtctactttggaatacgaatatatattcagctagagttaaaaaccagttccaactgggggcgttcgttccaggcgtgcctccagatttaaccgtaggagcctcagtagacacgccgggggatgtaattaagagtgacgggagaaacttaacctttttatttcagagatacgtagttcccgtatatagtgttgtcaaagggatagagctcacacaactctttccggggctggtagcgttgtgtttggacgtcccgttttccgatcgagggttatatagcaccaggacgccgccatcgcgtatcattgacgtttcgctgagtaaatatcaggcctccctcgtgaaattgatttccttagagcttcaaaatcgttcccgcgctaatgttgtatctgtttgcgaggtgatcgcgactcacgatttggtgactctgcagtatgagcgaggcttggaatcgctgatgcaagtccagcgtccccgcacccgcttttttgaaaccaagaaggctttggcgttcaatgtggaaacggattacgatctgctttatttcgtgtgtttagggtatattccgaggtccgtatctgcatcgtgaaatatacgcaaaatattggcacgtgtccagcttaaacaacagtttagtagaaatgaatccgacggagaaatattcctcggtatatgtcgccggatatttgtttttgtacggtgcagatgatggcagcgaactgcacatcgaccgcgaggatattcgagctgcaattccgacacctgctcctttgcccataaacatagatcatatacggaactgtaccgtcggagccgttctggcactaacggacgacgaacacgggctgttctttttaggaaaaataaattgcccggtgatgatacgcacgctcgagacggccgctagtcaggaaatattcagcgaattcgataatctcaaaacagaggagagggtattgtatttgataacgaactatctaccatcggtgtcgttatcttccaaacgtcttgaacccggggaaaaggccgacaaaagttttctggcacacgtagctttgtgtttattggggaaacgaatcgggactatcgttacatacgatcttactccggaaaatgccattgaaccgttcaggaagctttcccctactaccaagacggccctactatccgaggggcaagaaacagagcggctcttaggcgataaggtctggcatcctagtaaagaggcgatgtcaaccgcgttgttgggcaccgctctgaacaatatgttattaagagatagatggcgcactatttccagccgaagacgcatggctggtatatccggccagaagtacttgcaggcgtcagccttgaccgcactggccgagtcgatgacgtccaataacgcatcaacgatccatccaatcggcgaaaccgcaaactcggacggcatacaaaaggatgatcgaattgaagtgtgcgccacttcgccgcaaacgaacaaaaccttagagtccagagcattttcgggagggagtgggttcgccgggactcatgcgatctctccaccgccccagatgagcgcacaatcgccaaccgagatgtctatgaatactaaatctcatttcccccccggcgacgatttcatttgggttcctatgaaaagctacaacgaactggtgtcgagacaggccacgcacgcaattaatgcccccgaagctgcagtggggagccaggcaccgtatagttcctctccgttaatgattccggcgcacttgggacagcatgctcacattgggggatatggacatgcctccaacccgcaatttgcatcgggggccataaattacatgggcgggtttccatatgctctgcctatccaccccgttccaaccggccaatcgtctttggaaaccaagctgtcggctctactggattgtatgacgagggagaaaaaatcagtcgatggggatcgcggacgtgacgacatgttctctggccaagaagaacgaggccggcgcgggcgcaagcgcccgtacaactgtgacaaatctcccgagcaggaaccttattatccaggcgaattccagcagtccgagcatcgtaacttaagatgcgaagacggcatcgaatacgggcgagacgcgactcaaacgaggcccgccctggcgggcctcgtgaacgctgttacgtctttgcagaaagaagttgaacggttaaacggaagggcgcaagcccattcgataccggccgtacagcatatgcaaggaatgggaaccggattccaggcccccgtatactacgcataccctcctctcccaataccacatgtattttcgcggccgccagaagacggccgcccaatttcttccggggagggaagggcctcgctaggtagcgccacgggcactcctccgtctggatcggtacctccgaacgcttctcaagaacgtgtcgatgcagctcctaaaagcgacaccgttcagtcgcaagatactgtgaacgccagtacgatcgccaatgtacatcgcgccgacgatgcaggcgcggatattttcattaaacaaatgatggcttaaatgatggcaggggatccgctatgtcgacgtataagtttatacattttgcgaccgcaatagcaaataaaagtaaaataatcgtatgcgcacgtgagaatttatttatcgagaaacagcatcgcgctaaacggcatcgtcctccgaatcagagtacacaggcgataatctatcgtagtgctggccactactttttagcctcagctttgttaggtgattagaaagaatagcagtggtgcctcttgtttttttgcgcaaatcattttcgtggcgttcctctgcggacaccaacgccatatattttatcatttctcgagccttctgtaatttttttttatcgattggtgccttttccgagtccggttcttctccgtgcaactcgcgcgttgcctgggactttagctcttccgtcgtcactggatatagggctttcatcgggttgcctctaagcttgtttacgtaccagtaagctagaaacgcagccacgagtcctgctataattatcaatcctaccgctaaagctccgaacgggttagacataaaagcggacactccagatacggtagccaccacggcaccggcggcacccacaacgaccttccctatggcctgaccgacttgccccataccgttgaacaattccgccaggccgttcataaaagcgtaatttgtatctacttctattactttatttatgtcataaaattttagttcgtgcaactggttgcggcgagccacctcggcatagtccaataccccgacatctcgcaactcctctttcgtgtagaccgacagaggaagaatttctctgtcttctaacagtgttaagttcaggtctacaaacgtgctggctgtctgtatatcagcaacctctaccatcttaacaaagttatagtcttcgaacagagcgtatgcggatccaaacaggaagtatctccgctggttagccgtacacggttctacggcctccagtgttgggagtagctcgttattttcgccgagctggccttgtatcctcccctggttctcgccatacgaaaacaagaccagcgggcggctgtagcacatattagtagacgtggcgaccctcatggaattctgcaatgttaccgattccgcgtcgatcccagtacaagtagacacggcggtcacatcccctaacattttagccgctacgcgtctccctaaggtagcgctcgcgatggcgctcgggttaattttcatcccttcctgccataaagccagttctttattttgtaattcgcaccaggccgtggcgattcggctgaacatgtcgttgatatgagtctgtatatggtcgtagagaaattggagcatggcgaattggacggacgaagtagatcttatcgtagcgccttcgttcagcgccagtttttccttcggcgcattacggagctctcgccgcaaacgggacaaggagacatttgttttattggaaagagcatgcttattatgtactaggtctagcagctcgtctgtcctgttgtccctcatcagttctcttagatacatgtgagccagagatttcgacataacgggctgatacgccacaagaaatccaccgagggccaaaaaatattggaccttcccgaccttgacgtggctgtcgttatatttttgcgcgaatatgcgcttgattgttgtttcagcgtcgcgctttacgcactgacctagcctgatacgatccggatcgaattcagtggtattgctgataaatgttgacgatagctcgcgggccatgaatctatacttgccgttaaccgttgcgcgcaacatttcagtaacatctttccatttaaccatcgagcatacacgagcggtctttgctgcccagtcccacccaaccgtaaaatgtggagtgacgaggaagttacgcttgacgggtatgctcgccttctgacgcttgctcagatccattgggaaatagccgtctatctgcctaaattgttctagcggatagcccatgggttcggcggcggcctcgggcggggcgacgccataaaacggggacatatttgcgatatctccgttcgccattgcaaaatacgagtatgggaatgcagccctggcatccatttcttccactatgcagttgacagacgtccccgtccgatatacccacggagacccccatacggtataagtgtcgttggtcgtatgccacgccttggactcgggggtgttgaattttgacggttgtagaagtacctgtttttctccggcgtcgccgtcgtatgcctcgacgtatacattgtttctcaggtatcgcgctttggaggaacatctccctttcgcgtcgattacatccgtaatttcttcgatggaaacgggagtcctatctgtaaacctgttggtgatttgtctgtacgtcgtcccggtccaggtcgtcgtttgtataacgttcttataataaagcgtgactttgaatttgtatgggtttatattctctttgaagagtatagcaattccttctccccattcggtggcctttagcggttcggggcattttcgcggcggttctaaccggaccacggtcgtaccgaccgccggtgggcagagaaaaaatgaggactcgtcttcagacagctgtacgctcgagactgcttcccgcgacgttacgttttgggccctcgcgactcggccgaagaagtagaaaaccacagatatgaaaagtggaacgcagatcccactgaaatggttcattacgggttgatcttaacgagtctcatcgatagtgtggaaaggcgcgccgcggtacgaaagatatcgcactggtcaagtgggggtgtggtcatggtttgttcgttccgcacgtatctgatccgcagccgcgggagccatgtactgcagaatggaatagagcagcgagaaaacatccgcatcaaggattacggtcacgttgtctgattccgcaccgaggaccgttatgagagggcattctgtttcatatgtgacgtatattccatcctcccatatgtattccacgttaacattgagcggcaagcaatctgcacgacgcaggtgcaattcaccgcagctgaacgcggaagaaaataaagttgtcgccaaaatcacctcttttatatatttccaagccattctatgggccgcggttatactatctatgccgtcgaagtcgtaaaaccctctgaatttactgacgatccagtcagacgaactgcaactatgaatcataaatcgcgctatttcctccttcaaatgcggcaatagaccaacgttctctacactgaaatatagcgctgtattcgaaggttgggcgaacctatgtacatcgtgattaaacatcgggccgtttaacaaccgaaaaaatttgtgagttaggctggggagcatcgcgggatctattctgtgcttaagtaatgacgtttgcatgaaacggtgggcgtcgaacgcatcagcggtgatgcgattatcgatgatattcgtacatcgtttcctaatggcttccaataacctattcctggagcggaacccattgaataatgtcgtgtatgagtctatcaatatttcaccgtatacgttaacccgcagcattttttccagctcctttctttgctctgtaatacatttatccaaacttgcgagggatcttttacttaggcgctctgcgtacattttgcgtctccgagcaacgtcagccgatgccgatcgtaccaactctaaccagtcgtagtgctcgcggacatcgggtaacggggtaaccccttcgcgaatccgtagatgctcggagttactaaaatcgtcctcgggcgcgccgtcgccgtcctggcataggggaccatttctcgtgctatgcgaagtcacttgttctaaagtagtcttcagcgcgtcttgcgccgcctcctccgggtacaataaacgttttagcagaggagtcgacatatgatgatcgtaacatgctcttatcagcgcttctatgatgtcgtctggcgctaccgccctaccccccagaagcaatctgtcggccgcattcatattctcgatttcttgtgcaaacacccgttcgaaatgatccatgcgccgcccgaataccgtcatttccacgacggatgttctcagatcgaaaagacgctctttgaatgctaaatcttcgaggttgtccgcaaacgagtcaatcgtgtttgctctcggttggttaggtttgcgttcggacgaggcaatccagaattgcagctcgctaatggcatacagattccccgatgccggcaaaaaaacgttatgcgcgtccaggacggcggttgccgcatcggcgacagacactgtatcgccgctacctccgggatccttgtctccccttgtcggtctaatgagcgaaagtgccgcttgtacaaccgaacgcttttcgtcggacagacaagcggcatgtgggatgtgcgctaccatgtcatctgggtggacgcggagaacgatctgcttagttacatgattacatatttttccgattatgcgcttatgtgccgagtctccactgtttgccgtcacgcatagttcttcaaaacaaacggagcatggttgtgacgggtcgcacaactccggcgaaacgaccgatcccgcgcccagagtttcgattagatatcgatccagggccaacataaagttttctgcggttcccgcttttacgattaggtgacagtaattgagttgcttcaatatgttttctacgtcgtgtaggaatttaatctcggtccgcaccgaaccgccgtaagtatccaattcgacgacttcgtgatacggacagtccccggatatggtcatcgacttaataaaaaagccgtgtacatctccggtgtctgtaaactcgcacagcgcacgcagcagcacttctccgtctagtcgagctctacgcagagctaaccacaaaccgtagctaaggggactaatattcctctcgagttgctccgtcagcccaggagccattaggttttccaaatagcgtaccatgagcacatttaatttcagcggcttgatcattcgcacacctactctcggatcgcatctcttcagcagctctacttgaaacaagtacgattgcaactgaccccatacagcgagcagtttctgactagcgaatatactgtctcgctcaacgtctagcgcttgtgcgtttccgtgaggcatatccaacgtctcggttcgcctcgtctacgctgaattggacctgagtcggagggagagcatgatgatatttataggggttagccgataacgccccatccggaataagacccacaaagcgatataagaaagagtatgctgtatatttcatatttccgtatacaggttgaaaagccgacaatgacgtagtatctatcttgataaggctatgcgagcaggccccatccgggatatgagctaggtagttcgatacaaaagtaaacgcgtttagacccaaacacagattttaaaagcccgcaacccacgtactgggacaacaatacacgcggttatagcatatccaccgatagtcctggagcccgcttttcgggaacgggctccaagtcaaaaacgtccgaacacggacgtttcaaagttggctctaatatggacgggccgtccgcgcgtctttccgtattctcatcaagagcatcgtaattaaacgtaggtccgtccagcgggagagccttcgacatatcgaccatctctttcgctaatatcgcggcagcatcgacactccaaccgccctcgcatccctctacctgcttgttaagttcatctatcaaagatgagatgtacgcatcgttagttatttccatccagtcatccagttccatttgccgtacacgatctccaaccattttcaacgcgatcatatatacggcggcatgaggcgctccgcactcctcagataaaaccgcccgggctctatccacgagcgtggtttccttcaagcccgaggaaaatccagtctgttccgatacaaagccgaccctaggacatgccatgacgaaacggtgggttctattaaaagacattatggagcagacgtttctcccacccattatgttgccccagttgccggattggaatacttttgtgctaccggccattccgtgatatttactgatgctgacggctatcacaacaaagggtttagaggccatgataggaccgacgagattagtagatgaaaaggcagcacaccatgcttccttatgatcacagatattttttagcagttgctgggcggctggtgccacatctgacccttgtgtgaggatatgttcgatccagggcaggaccatagccggatccctaggtcgcttggaggttgcaaccaaagccgaaatcgtgttgataaagaaatgcttatgtgaacagtacctcaggatggtattcgctagataaaattgagccagctccccgaagcatgtaggactgatgttaatgtaattcatatcggcgtagctattggtaaaccttttaatgaatgacgtgttctcctcggcatctttggagagtataccggccggcaactgattgcgttgtaagaggatccaaaaccagagagcattgggagtcgtgccattaggcatcttaacattcggaaaaagttgcgtgtgataccgtttgagcgcaaagccgagagggccattgagcacatgcatcgcttttgccggccgttgatacgcttctatcatgcccgccagccgggattttgtagcgtcggagacggtactggaaacgcctccgacgaacataactttattcttcactttaaattcccggaatatctcaaatgtaactttcactagatctccttccatgtgcaccgccagcggatcatgctgagatttgctaggatcgggaacggagatttgttgatcctctaaggtcaccgttatgtttttagatgtgatgaacccggcgttttgcaagtccagtacgcgccgcctgagtaccgcttggaactgagtcctaaaatttctagcctctacttgttgcccgtgcattatcatagagcactggcttaacgccatatcttgaacgacggcaattatcgtgcgcctggataaaaatgagagcacgggacatatgcctgacgaatacggctctattgccagcgaaagggtatgggttgcatcacctagcccttcgcgtatgttatattctctgatttctgtcaaatttcgcatcagctggccagcttcgctctcgattatattagccattgtcgatagagcacgcataaacgatttgccatcccggatgatggcatctgcgggtgtcatgtctgctgggtcctcgcatgtcagcaaaccttctttttctaacgctttcattactctttcgaccgtcagcttgtacgtgtcctgcattacactgcggctcgtctctccctccgatcgtttgagagtcgagaatggggcgtagcttcccagcgcgttcacgtcgcagtagttattcgtcatagatccaaagagccccatagccccacgcatctgatacccgaatttcggcaatcgatattctaagcgcttaattgtggtatgggcgcaataaatacgcgacgctttgtcgcacaaatcgcatggtacgtccgcgtccatggcagatgaaacaaatttcacggtatctaaatcgtgatggcaagcttgagatccgccgtcacacctctccaggtagaacaagaatcttgccagcaattgcggacaaaacccacacgccaaaattaggtaatctaacgagtattccgacgggctggccgatgtggctttggacaaatcttcgcccggaatcggcttgccgtctctatcgattaacgggtttgaggccaaatgcggcgcggctatttggaaaaaccgataaaacgaggctgcggtcgtacttgtgtcttttccgtctgcgctactcgcttctcccacctcggtcatgtatataaccgaattcgaactaaacaccattgccccgaccagtcctgccacgcgggccatatacgcagacagcgcttccactctatctgtatatccgatcggactgcaatagaggggccatttctttacatcgggtatagactcctcgtagaccgatgtcgcgattacgttttctatggacagagtagcgtcggatgccattagagaagccgtcctacgttcataccccccgccagatagctccatgccttcctttttccccgctttatactgcgatttcgaagcagattcgatgggagtgaatgcgttaaaagctgtatctgcgggtaacaatgttccctcgtgattttcgtcaaagcttaaatgggcggcacagcgcgcaatcgcgtctacattgcgaacgcgaaggcctacggccgcggtactgagcacataaccgtgtaatagacgacataaggaatcattatagaaagcctttggcataagagctccctcgcctagtgctctaggcttcgtactaaatggatcgctggcaacgcggttgaagtccgggaaaaccaagtgcaggggatataacggtattctacgaacatcgacgccattaatgctcacgactccagtaccaccgtaatgtaaatatgagttgcagaggtacacggcctctttaaataattcggtcactactaagtagagcatagtttcttgaggattcattccgagattatcgcatatttgctcgccggttgtttcgaacgacgtggctaccgggggcgaataggtgctgtagccgaatcttcctcgtgccaaatcacatgctttagtcagattcggagccttcgtgcacggttttatacattctccgccgtgaaacacaaacacgcacggatggtaatgcgtcggaacgagcttgagagtagttgatccgctacccagacccgttgtcttcgttcctgcaacagctgccacgttccacatgaaatccgcttcaactgtaagacctgaaacgagaggcaatatcgcatcctcgcagtcattgctcttggccgcgaagatcgagagatcttcagctggcatgctgctcgtgggtgcagcatatacatatcctatcggccccccggtgatcttaacgcttttccctacatccatggttaaggtgtcagcgtttatccggtagactgtacaacggaatggcaaggggcgatgtgccttccaaagctgcgaacgccggcttcgccaggagatggcactttgactttctcgtgccggatgttttaaagccagaggacctccaaaggatatgacgcaacacttcctaaagtgcgccacgaaacacgtcgcgcatattgtatgttttataagtcctcgacttcaaacttgccttctctgtaagccgatatgtcagtagatggggctagaacttttttcaacccgtacctcggtgcacgaaagaggggacgggatgaagatagtaccataccgccgctaagtagaccgcgggacggggagagataccttcggcaacatcgcaatgcgattacctatatagcgactatagacgaatttaaatatatcgcccccaaatgcttagacgcggcggaaataaagcagcggggcactcatatcggcaaattgaaacgctcgcctatactgtacaaaaacggagaggaacgtgagttcttgaatttcgaggctttgggggacgcgtggccacggagatgttttagctggaataacgtatcattcttacccacggaattcgacccgcgtttttctaggtttcatgtgtacgatatgattgaaacggtagagtttgcaaatggggcaacaggcagagataaaaaccgttttctggagctattgcggcctatgggcacgattattaccatgatgggaatgactgaatgcggcaggcgcgtggctgtgcatgtctacggcgtcaaaccatacttctatatgcgtaagatcgatgtagacaccgcctgcgggagtcgatccacccgcggactcgctgagcagatggcgagcgtggtacgctcgtctgtgaacgaaagcgcaagaaaacgattttacggctcaagcactgtgacggccgactgtttcgaagtggacgtggtacgtcgtaaggatatttatttctacgggacagattgcgaagagtattaccggattaggtgtcagagcggcaaattcgttgcgctcatatgtgataactttcacccctccataattaaatacgaaggcagtgtcgatacaattactcgaatggtgctggacaacgccggatttagtacatttggatggtattccctaaaaattgggaattgcggtgagaaagtacaagttcgagcgccccagcaccatgttacttcatgcgacatcgaaattaattgtacggtggacaatttgattggtcatccagaggacgatcactggcccgattacaagctcctatgctttgatatcgaatgcaaatccgggggagcgaacgaatgcgcatttccggtggccacgaacgaggaggatgtagtcattcagatctcgtgtctgatgtattcggttcgacaaaagcaattagaacatgcgctgttgtttgccctcggttcatgtgatcttcccgaaaccttccaagagacgtttcgtgatacctatggcgttttgcccgaagtcctcgaattcgacagtgaattcgaactgctgttggcgttcatgacttttgtcaagcagtacgccccggaattcgtaacggggtataatatagtcaatttcgattgggcgttcatagtgaataagttgaccaccgtttacggtattagattggacggatacggggttattaaccaaagagggacgttcaaagtatgggatgccggggcaaacgcatttcaaaaaaaagggaaatttaaggccaccggaataatcgctttagatatgtattgcatagccaccgagaagttgaagctgcaaagttacaagttagacgtggtggcggaagccgcgttgggggagcggaaaaaggagctgtcgtataaagaaataccaacgcactttgcggcaggtcccagccaacgtggaattataggagaatactgttttcaggattcgttgttggtagggaaattatttttcaaatacgttcctcatttggaactgtcagcgatagcaaaattagccgggatattgctatcgcgagcggtattcgatggccagcaaatacgcgtgtacacgtgcttactacggttggcgggctcgcgaaatttcattctgccgaataagccgcaggtgcgtgcgggaaccgagttcgaaaacagcatcgccagtacggatgaatttgaaggcgaaccttccccttcgaatccaaaggcatcctcatcatttcatggaaatggcggcagagtcgtcggttaccaaggagcgaaagtgttagatcccatttcgggattccacgtcgaccccgtggtagtctttgattttgccagcttgtatcctagcataattcaggcacataacctgtgtttcaccaccctaataaacgacgacagaaaactcgccgatctacgtccacgcgatgattatatggaaatcgacgtacaaggaaaatcgctgcattttgccaaaccccatattcgagaaagtttactgggtatcctattaaaggactggttggccatgagaaaagcgatccgagctaaaatccccgctagctctgatgatacagctgttcttttggataagcagcaggcagccatcaaagtggtctgcaattccgtgtacgggttttgcggtgtggcaaacgggctattaccttgcattgatgtggccgcgaccgtgaccacaattggtcgtgacatgttgcttacagtacgtgactacgttaaggttaagtggggaaccagagatgccctcctccgcgaatttcccgcgctgacgaattatatgttgggcgacgattactccgtgagcgtgatttacggtgataccgattcggtgttcattaagttcaaaggggtagcgatacagggcctcgtcgcaaatggagacgatatggcaaaacgcatatcgtccgatttatttcccaaacctatcaagttggagtgtgaaaagacattcgacaagctgttgcttataacgaaaaagaaatacatggggacgattcacggtgggaggatgttaatgaagggagtggacattgttcgaaagaataattgccgcttcattaacacatacgcaaaaaagttaagtgatttgctatttcaggacgatgcggtggcaaaagcagccgccctcgtcgcggaaaggccttcgtcattttgggcaacggctcccctaccagaaggcttgaagcccttcggggacatattggctgaggcatacggtcaaatgacggcaagcacgttgtccgacgtgggagatttcgtcatgtcggccgaactaagtcggccaccgcaggcctacgctaacaaaagaatagctcatctcaccgtgtatcacaaattggccatgcggtccgaacagttgcccatggtaaaagaccggatttcctatgtcatagctgccgcaacgccggaggtactgcgcgatgccgagcgggtagcagaagccagaggggaaaggaaattccgctttagcgaggtctctgtcccggaggttccagggacgtttagcaacagcgccaagacgcgggccgtccaaaaacccaaggtattgatctctgacatggcggaagacccgacatatctaatcgaaaacaatattcccctcaacacagattattatctatcacatctattaggaactctatgtgtaattttcaaggctttattcggcaatgacaccaaaacaacggatactgtattaaagcgatttattcccgaaacttatacagaggatcgcgcctacgcgacgcgagttgcgcgcgccgtctttgcggagatacgcagcggggccggtctaagttctagcgaggaggaagaaactcttcaaagactgaatagagctttccgtattctaacagaagttcgccgtcgatattaatgtcgcatagcttacagtacacgtcgtcggcgttgacggctgggacatcactcgaatctgtttgacgatcgtattcttttctaatgactaataaaaagttaccgcgccacacgtgagcgattatgctgtaattcttacaggccgtttttaaacaatcaatcaatttgtagtggaggtggagagctttcccggggaacacgacatacatcatgtattcaagggagcctgcttcctgatccaagtaaaacaacaccttcacatttttcattccagaatcgagtagcacatagtatgcgaaaaaaagttccgggattgccaaaatacgagaaagggcaatttcgctatctttcccccgctcctctccgcaccccattctgccgcccaaggccacgatagaagccatgaaattcctataatgataaatgttgtttatctgttggacatatgccaatatcaaagaggcacgatcgtttcgccccaatcgcgggtctccgctagccgtgcacgtagggcaacagccaccaactccgagataataccccattcccgacaaagacaaacagttatctgcgacagcttccgacatattgaacggcaacgagactggcgttgtcttgatgatcggcacagccaaatccttgactaccattagttcctccgatggggactcttcaacgaaatcgaagtaagcgcgatacaaatcgacatctggttttcgagacccgcgtttcgtaccgcatgccggcgcttgtagatctcgccattgccgccgcgaccgtcttgctatccctccgctacgccctacagatctgcgtcgtatgaaaatgcaaccggtcatgccgggaattacgatgtcacacgtaggtttgtagcgtgtgctcgagagatatcagggatatagagtgtctttgaagaaatgcgccagcgtctttgacgaacgcggataaagtagtcggccggggagggaaaacctgatatgtcttgaacgtgtacgccaaggcccaaaacccggcgcatacgcgaccttcgaaacggttatggcttgcgagccgagctttatggagtgccaattcttcccggctcgctaggtccgggtggtcgaacaatgaccgtggattggtctgcgctatccgcgcagcacacatcgggtcgcaaaagaagtgtttgtagattgcttccgttcccgtgcctttgagcagcgccacgaagtatccgtcatcttcaaaatcggcatttctctcctgcgtcccccacgcctccaacaccggttctatgctatggaaaatgccgatgttgttagctgaataggcaatgatatcgcgcttaaattgccgcattgcaagccagtacgtgcggattagtaggaagttgcacaataagcattccgcggacgttccccctttggttatcgcgtgctttaattgtgttaccattaagggtcctaactccaaatcaggttctgagtcatcttcgtaacagtgactatatgcccgagtcgcccctctagcaagatctattctgttgtctttccaaaacttgctgaccgtctccttcctaaatttcgctgccataagagcgagttcgctcgccccatctggtgcagatcccgtgcccgaaagcaataataggacgagattcgtataacccatagtagagtcctcgccgctcgaccgttccgtatactgagaccgattagtgcacggtgctagtgcaccaagatcgttctccccgtcaggcagtgctttgctcaaacgaagctgcaattcgcgctcgtaaatatcgtcgtccgacaatgcgcgtataatgcaactttccgtttgagaaaaattacattctacgcttctcgcgcagtccttccagcctgccaaagcgacggaaagcgaggtgggaattgagccgaccgtttgacccgtttgtgggactttccttttactttcgtgtccagctgccgtgtcgcattggccctcgtacgacgagtgacccatgtcggacaccgtcgtcaacatggcccgcgtagcgctttgggccaaatacgaatagttactgtacaacactttagcgtcacccgcgcacagcgaccgtcctcttttccccgccgaacggccttgatttgcacggggcacgataacctcgttatgccgtcttcccggtacccccccgtcagttcgaaaacaaccatgcagaaagaagtgtctctggatatcctcaaaagttaaatgctttctcccaaacgagcctaccaacgtgcaaccgtgatcgaccagaaaatgcttatccattatatacacgaattcgaacgctgctataaacattgttgtagcgcatggtggagaaccaagacatttggaacacaaaaatgcgtaatcggccatccatatagccgataatccgaatttgtgcttatatatatctaaaacacggcaaacgagacattgtctatctagagcaaaaacctcggctgccgtcccgataaacgtcgccagctcttgatgctcgattccgtcttcgcaatcttctgcgctttcgctaccactgcaactctgaccagcctgaagactgttggtcttaatagcgtgggcggagagtagcaattcgttaaagagcgtatcgttgtacgtcaatatttcaggatcgaacgctatgtaagggcattttaaggactcctcgacccatccttccgacgcggatgctcccggagatcgaataaacggtagttcgacagtacgatgggccatggccgctgagacaaacactcggcaagtagatacgcctcggttagccgacgcgatcccagacgtagagttgctgtcggacgatgtcgataaattagctgaacgctatatttgcgacgggatcgtatatcgcgtatggttcgaatacctaatacccgatgaattagatttgattttcccgacaaccgacgggaagtttaattatctatcattcactagaagacttgcttctgccatccgacatggtcgtgccggagctgggagtgcgacccctacgtcgtttatcagtgccgagcgtgtctgtgaccatggggccgttttgagagggcggagcgagagatttgcatccgtaattaataggttccttgacttgcatcaaattctgaaggattgttagaaactagcaagccgaacataattgctccgccgtatatctttttttcttttacgaaggcatacagcgaatgatgagcgcgcctcagagtaagccctgtcgtcgtgcaggactaatagcacggatcaggctcatcgtcggcggagatttaactatgggcaattccgatcccggactcgcggagtctttttccggtcgcgttccggcacgttgcgtatttcaattcagtggggcagacggcgtggagagcgcgtttcccgttgaatacgtaatgagaatgatgaacgattgggcggggggtgagtgcgatccctacattaaaatacagaataccggcgtctccgttctaatcgaagggtttttcgctcctccgacaaacgccgctagagcgccgctgtgcgccgacaaagtgaacgtcctgttaaacactaccgattctacgggcgtcgttttatctgatatcaaaaggtttaaaaaatcagtgggtgtggattgcaggcctttccaggcttgcctaaacgttcattgctttgtaaggctaccaaatgttcagctggccttcagattcgtcggcccgaccgatccggccagaacatcaaaactgctcgactcggccgtagcgtcttacaattcgaaagcgaaacagcggttcaaaaacagttcgagggctatcgataacgaatcgagaccctgcgcacttcatgagtgtgttccgatcccggtaagagatgaaacgcagaaactgactagccaatctgatataaggacccctaggcgcgtgctgaccatactcaagaaaatttcgagcggtgagtacgtaacgaccgtacgcgtctcgatccgcaaaattatactgtgcctggtcagtgtattcgtagttataaccgcctggtggtgctacccgctctaaaacctcgcgacgcggcgtcacgtttccagtcggaacaccgcaccacagagtcatcatcggcgccactacatcgcgcgagactgcaatgtctcgcacgccctctccccagctttcgcctgtttcacaagcgttcgatccctccgacttgagcacttacaagttggatgtgctggttaactaccccctctcggatttggtgcatcaccttaatgccataccgcgaaacctgcaagtttccgacaggcattccgacctgaacgcagctaaaatcaacgttttacgggctctttgtgtgggattttctgacgtgcggcgcaaaaatgatactcgcactttacaacgcacgcccatgttcgcaatcggcgacgccgcatcgcgcttgagaccgtccattggattgaaacggacattccccacgggcatattctcaacaactatcataaactctcccgcagacgatgatgcatagcttttgtgagtcgacatgctttaataaaaaattatccaaatcgaacgagtctacttccctatgtcagttatccggtcaggagcattttgattttaaatatctctatcgttaatgtatcgattctggctctcaattgttgtcgtgcgtgtgcgatttgcctggccatcttttcgcatgccctagtgagtgcgtaaagcgcgctgcgtcccacctgcctaaaatcgcgccttgtcaataatctatcggcagagattactcgggacgcgctcgattcgtccgtgctggagcgatcgctatcaggaacactagattgcgactcgccatccgtgttagaatccacggacgatagagactccagcgcaaacagatatcgctctgggtcgatattggagtcctgttgcttattttgccctgcttctgcttccgtgaccacgaaccctctgtacatgttgtgatggtcgtgctttgccgttgtcgccttgcatggcgaacgtcggcacgtattaatgggtttcgactgcgaactagacggctgcgcgggtctcgacagaatgtttcccagaaccgcactactcggcgacgaaggctccgctaatataacgtccgggggcgcaaatgcgaagtggtcgtacagtccgtgctgcgccggactcccgaccgccgcctgctttttgccaccaggtgccgtcgagatatcgacggagcggtcaaccggttccaggttaagatccgcggtaataacggctggcgacgctcgttgtaacaagggagacgagtcgcggcgcacggaagcgagtccccctaaagtatcgcatcttggccttgacgcattgttaggacgaacacgggcggcgcccttgtccgagatccgtccgattgaatcaatcctcgttccggcacgcgacggcttcagcgctcttatccctattcctccgtcttcgtcgtcgggaatcagggattttgtcgaagacgcgacaacaaatggtgttgaggtcgaatcggagtcagatcgatgtggaatgtttggagttccatgctttttcctatcatcgcgtaccgagttatccgaaataactacggcaggggacttttggtcgagagcgcagccgggtgcgttacacgcggctgccgtatcggtaaattttagcctcccacgatagacaggctttggcatatcgtgcgcccgttcgctgacatcgatatgttttacggggcgccccttctgcctctcctcgatcccgactgctgcgtaggtagattgctcgttatgtgtttttttagttacgacgagtttttgagtggctggagataacagggacgggctcaatgtttcattatttgggggggcgagcttatagtgaaaggcgagtttggaagaggcgccatcggaagcatcggtgctaaccgtagaaggacactcgacattctcgggaactacccggtcgctacgatcgttcaactctttatgaaacaaaaaacccgtttcagcattgtcgtagacgtccttctctgcagccatcccatcccacatgctctctctatcccgactaaagtcattccctggtaattcttcatcttccgacgccgttccaatagatagtacatcctcgacatcgccgtctcggctcttgttgtacacggggatcggatattgtctagattcgtcggaaaaaaaattagccgcgtcctgtcggtcgagcacggcgatgtcatcatatgacgcgcccgtttccacgcgaatgcccgcatctatgtatggcagttccgagagaacagcgtcatcgctggaagttagccgtattacggggatagggtcgaataccgtcttaggccatagaactttcacgggaaccattcccgtgtccactatcactaaacacggaggagcggaagaaaggggcttggaggctatgagatgggacaagtgttccagctgttggccgaggcatgcattttcgattggattgctgtcgtctgccaacaatttccccccccaggaagtcgtgtcggatgaaacggcggcaggttcgagaaagcagccctcggagccgcttctcgagtcgaaaagacggacacacagattcagtccagagccggaggaatacgcttctggacattctgcggcgatcacgatccgtgccccgaataatgtagctgcggctgccagatccatagcgtttacttttaagactccgctagggggtgtggacgtgacggtaaatgtcatcgccactcctgtgggttcatataaattgggaccgtctgaacctttcgggatagttttgtcggcgggacgtaacacggacgatgtggtcacgtctaaagtcgaagcagcgtccccgcgggctgtgacgacgtcatcgtagcttctacagctttgctctatctccgcgggtagaagcgaggaccacatcaccgccaatgcggttggcggaatgcacatacgagccagcactgttgtcgttgtcaaaagattcgacggcacgaccgcacgaattttggcaaggcccgtactcgtagccccacctacaccttcccagggtttaagggggtctgtttcggaaaggctgccttgtttccaatcagaataccgcaaagcaaaaagggatccgcctgacgggtcccacgctccgcccgttaaactcatcggtcggcaattcgagtccgacggggcatctttggatagctgcgtagataaacagttgataaacgccgtagtggacagcgactcattgatagcgccatagagcgtcttatccataaaatcgtactggctaataagatcgagctgggaaaaggtcaagacgtgccccggcatgcacgtcataatagcaaccatcacgtcggccaactccagccgaacgggtcgtccatttgcagctatttttttaagcccctttttgtcggcggcaggggcgacttgccccggaagaaaaaaaatatcagacaagctagcacccgttttacgcgtgagcgtaatggccattaatgcgcaataaatggacccgatcgcttttactgtgccatccgccagccaatcgtagttttgcgtacgtacatacttggtgaaggcgcggaaattatccgccgcggcttgaacgaaacccagcctcaaggccatgatgtcgcctagcatgcccgcggcaactaccatatctctagttgacataacttttgaagggatcgcgggcctcaggcttaggccggagggctcgcacaaacacgcggccattttttcaccaacagttcgatagcagacagaatatctcaggggcgcgtcggaggcgtctaaatatgtatggatgcctgggatatctatttcagaaaacgcctcctgcagcgtgacaacaactgatggtctgatccaagcagctactcggtgtttaagatatcgatccacgaaccccgcggccggtctgttgttcgcgtcagcattcaatcctgtatcagaggggaggagcgatggacacccggcaactcccggcaaaatggcggaatatgcagcatacagcgccaatctcagctttacaagccgcgagtatcgagttacgtgccgaacgtaccacttggggagccgtttagagagaatatcgaattgcgaggctattgtactgagatcgtttaagacaaaggttggcgggatctttgcacacagagtgtccatctgtttttgaatcgattccgtttctttgagggccgccagaaaagcatccatgactccggctctgtctctgtatttcgcatcgataagtccgatgattttagccggcagcctagcatactctgcgttatcgcgcaaagcgttgatcgtattggaagagactttagcgcgagcagcactatctcgggcggcggcaaacccctctgagctcttgtccatcctgtccttatcgtgcataaacgtggaccatgtgtcatcccaagcgacttcggcaagcgctagttcggattttaactcgtccaatcggctcgctaagtccgcgagagcatcgatccgctccgcgtatatagtcatcggaccgctttcgtcgatccgggaagttagctcgtgcgaatctatgacagatcgggcgtgttttagccactctaccgtttgggtatccaattctttagtttcttcgactttactcaaaagtattgccgcttgagtgactatgtcgttcgcagtttcagccttttcaatagctttcgctatatgcggaggcatcgcgaccagccgcagcaggttttttaaattggccaattgctccgccgtctctctgtctgcggcataagaaacttcggccaaactcttcagaataacttcagctctcgatttcgcgccctcaatagctgtcgttacccgcagctttattgaggagacggcttctatatcgcgttggagagtatgagcgctatactctgcataggctgtcccgttgaacgccgtaatgtcttccttttccaaatcgttggttattgtcagtatggcgttcgccgaaggaatcacgatagagaccccatattcaagagcgcgacgcgccccctcagggctatacattctagccagattctccaatgcctctctaatttctatatctaccctccccgctgcgtgaagagcctctaccctcatttgttcatgccgagctaaaaagcccgtaaattcctcatgcccgttacgataaaaatccacgtatttggccaacgttgggaccgctcttacgtctggttcaatttcgcccaataacgtgtaatagtccaagttcccgccgcgggcatccgcgtgccttaatatagcgagtactatcttgattaactgtagcaaggcgtcgcagctaactccgaaaagttttgtgtaataaggagccgccgctataaacgcgtctagccaggtcatatttttcaaaaatgctataggaggcagaattccatgaattctattcggggtggaaaacgggttgaacttcaatacagtttctatcgcatcgtgaatcgcacgaccatgcgacataacaattttctcggctctggctctgaaacggatagtgtcgtagccggccaccacggcccttttctccaaatcactcatctccatagcatcaaattcggatttcagctcggcattggatagtagggaatgaatcgaggaaacccaaacgtcttcgctatgcgatctctgggcacttatcagatttctctcgtaggttgtaacggccgcctccaattctacggtccgctgatttacaagccctaccgattttgccaggtcggcaattttacgttggatgtgggggtccgtaacatgcgcgtgactctcgagagctgcgatggctgtattggcgtctctcgcgctctgcagcgcgtgagctatttcagttctggcgctcattataacactggcgtcgctatcagcggctgctgttttgggatctgaagttttgaccttggttattgacgcgatcacgctattgagtgccgcgcgcactgcccgatgtagaccatctaaacggtccccgtgctgcgccacgcccgcggccacctcagcgtcggataacagcaccgttaagaacgaaaacgcgtcatcctggcctgcgggtagatcggccattattcccgtagagggagtgtctgcagtcgccctgtttacatcggatacggcgttctgcagcgccgtaacagccgccgtagttttttcgaccgacatcggttcgaggcgcgcagcggcgactgctgcagaaagcgtatcggcatgtttcccgaaaaaaaccgacgcggccggataacccccaattggacccaatattacgcgtatggccagagagaaaggaatgccgaggccagataactctgcggcagtgctcgtactggggtgtgacaaaattgtcctatactgagagaacaacagccacaaatccgttcgcaaagtcccaataacatcgggtggtgcgagagctagaaaggtctctagcggccccgtatctccagggatggattgcgttatggttttgactgtcgagtccaatgcgcgcaacccagcaaacctttgtagaggacgcagcatcagcttaatcgaagaatataaagttctgatctcctcgtaacgatattgaagtgccgcaattaaggtttcggcatccagccgcctacgggcgatagccgcgcggtcatccgaacttagcaaatttgcaaatttgtcgccccctaaagcatttgacaattttactaactcaaccacatccttcataacttcctccagtttttgaagatcggccgttgtctccaaatcagtgtatgacgcaactctagcttccaactcatgtaagcggtccaaatccgccagggctgtttcacggcgggcggcgttgttgttaacggcatcgacttctttgatcagtgtttcaaactcttgtcgactaatccacccgcccgcttgaacggctgccattgccgttttccataccgccagattttctggattttctaaattagagtcattttccagcagatccccgagcaatttagattccggtgcagttgttacgggcggcggggcctgcgcgccactacgcgccgctactagggcaataacatcatcgagcacagataatgatgcgaacagcctggccattttttcatgttgctcgacaacgaccattttaaatctagatgtgctagccacgttggctcgaagcgcattcgcgctatagagagcccccttcaagtaatattcgtgtagtgcgttgccgactgcatcaacggctgccctctcaatagcagtcaagcgctgtgtaacgacagatggggagactttagctatgctctcgtcgtcgcgcgatccagaagtacccccagatcctcccattataaatgcatcaaatgaggcgtgcatcaatcgaacgccggcgtcgagggcctccaattcagctagtatgagttccgccttcctcctggcaacagtttccctatcacgtatgaacctgcacagcgatgcgactctgtcggtcaagctctgttcggcatgcaaagacgtcttctctgagtatatctttcctggattactattaaacgcgcttactaacgatgtcgccatcctttcgtagattctatctgcatccgcagtgctcgcctctctctctatagagtccaaagttttgtgaagggcatctgtgagctcctccacttccagagccactaataccagcttgcttagggccaatttgcctatcttggaattttcagaaagtacagattctatgaggtctgcagattctccggctcgcgaaaccgccattcccgtagaatcaatgaacgcgctaaagtgggcgggcctcgtaaatgctttaaataatgatgccatctcggcttctacgacagatcctatttccgttgtggttcgagcgccgttttcgataacgtagttgaacaatctggtaaaagtatccagcccacatatatccagaagtccgtcatagtcacccgaccgtgacaagtggatggtcattcccatacttaaagctatagattgctctaaatcatcgatgttagcattgatgtcgctcagaatagagctagggacgtgttcgcttgtccatagcccgtctcgtagcgactcgtccccttcccccgctaccgtgtgaggattaaaaggtggccggtctcgcaacgattggccgtgcacgaagtgctcagcacgcgcctgagaacttataaactcattgaaggagacattgtccggccgggtagcttcttcttgaccaggtatattatgtgtcgtgctcgatccactatctgcttgttcagacaaacttatcgatggagccaccggattgtccgtataggtcaaacatcgtttagttttccgggacggttttctgctcgaagattgaccttggccatcgacggataagttctctgaacttgacggaggagtccatacagggcgcctcctcttatgtctctcaaaagactgtttgggcggggagctagatttcgtgtcagtttcaagccgaactacattttcccgcgttttgggcaaatcaggccttgttagcaccgacagatcatcgccgatgtccgggaatgcagtggtccacgcatttacgatggactcatgattggttatatcacatatggcatcaactggagcctcctcgggaggcaggacgtatgcgtcctcctccgcatagcccatttcccgcctaacatccacatcccctgcagcgacgggagaacgatcacttctggaatcgacagcgactttgatgtcctcgctacgtgacgtggaggttccaatgatgatcctagttgttgtaggctgtggcctgtaagggggatcgagattggccagcactactttaatgttctcttcctcgttaaccctgcctagatccaaaacgatgtccgctgtaccgtacagccgtgatacggctgatattatttcttcctttggcggtgtactggagatcatagatacaaagtaaacaaaggtcgcggaccactctggcgccgtcgagggatccgcataggacgtgagatattgataaaaataaccctcgcttactcgaacgatacacgcttggcctatgtggccatgaccgtgtggatcgaaaatgtagattccgttatcggatctgtacacccctattcctatgacgccgatgacgatcaggcaataaatatcacctcgtttctgcttccatactttttctatgaatgtccgcgcagatatttgggtttctaagatagtggaggtgttttcatctacgtagaagtccaattctccataggagctcgaaaacgcaacacacaagttgccgtcgggctcatttgataagatcctgtttggtaaatcgtgagggacgcaagtcgtataccttccatcgcgagaggtttctattgtccattcctttccctgcaataacagtctatctatggcctcggtcgacaataccgcatccaacccatacgcaaaaactacgcgcagaaacgccaatgacgaccgcaagcatgaaaccgatgaccccggactcaagtccggggcaaattgattcctgttgccaacggcaactagtgtaaagtcggtggcatcaaccaccattcttgcccattcatctaggattacctccgaatccatgtttgttcccgaacgcatggcgcggttttgcatgttcgagacggagctgtccctcgaattatccgatgtttccaagcgccgcgtcgagggactcggttgtaaccgcgtagatttcttggatgggcgtgtagtgctccctctactctcactagcagccatatagacgatggggcggaatggcgcgtcttttcagattgcgctttgtcattgagcgagttagacattaaaagttgattaactccaaaattgtgatcaatcagttgcggccgcgtaagtggcgtggctgcaacatccaagtcggcacgaacgaacgatacgccaggccgtaaaacgatagacgtgtgcgtcacgcattgcgatctctcgcctgcctttcgttattaaacaccgtatcgacaatgtcgaccaaaccgtctacagttactctcggttttatgaggaagtccttcgcaaaattggcaaggtccacatcatcgtgtgccaccgtatccaaatccaatgtatcaaaattgagttcgtcacgatgagttaaattgtgcctcgatgtcagttcgactactagggcggggctatcgtcggttactacgggcagacggcccagcagggtcgctacagctgcgtcgatttcgtcgttcgtgacacggtcttccatatcacgcggaacctcgatccgatcagctattttttgccatactactcccacattctctatagcactggccaagtcctgcgaacttctgtcacgaaacgtagaatttatttccgacaacgtttgccatttgtccagcagccacacgatatcgccggtcccgggcggcgtggaacacgatgtcaaggctctgacgtgcaggtccagcgaattctgcaggcgagccaatctggcatagtcggttccgagggtagaaaaatagcttgctgcctttacgctaaataaaattgcgcgctccattaaattatcgcatgtatgaacttgtttcccagtttcttctattaaagtccgcaacaccattgatttgagtcttacattcgccattacatcacccgaggagtcgtagaattccctgagagccgacagcacatcaacgattttccatgtgccaaaattggcacgcggctcgccacggcggtaaaccgttacagtacctcctgctgtaccagctgcgaatttacacgcaaagaaatgcttaaatatgtacgcaaatttaaccaactgcctggatcgctccgctaaatatgccgcacacttcaacgttctatccgctaagtaattgaattgaagtcctagggccgttccatgcatactaatcaaaagcaaactattcgatatctctggacgggggggcataatcggtctggtctctggcggtaccatctgcacggccgcatagaccacgtcgtacaattcgcccatcagcatttccagattatacgcatcgtccgtggtaggcttggccgtcagatctctagcaaacggagcgagtgaggaaattagagcattgagcttgtttctatgattcacgaaactgccaatgtacggcgcgccgtaatccctggcccaagtcaaaatttcgataacagtgtttatcgggcgttcagaaaagacagatgtcgtgatagccgacaatgcgtccacgcaaacggtagctagaatatatcttagaaaatggggagttgtgctttcaggtgtgatgggcatggattcaggatagcgaattgtcatggccagacgaatcatacggctctccaggtctgggtccactgcatttggtccagagatactctctaaatccgaatggtccacactagctagatgttccgacggttcacctccaattaactcttccggtggcacgattccccatatatgctcggctctggagtcgaaccatagcatgagtgactcctttgcaaattgtattgctcgattggcagtcccggccccgctctggcggattgcgctatccatttccgcggcgaggatcgctcgtgcagactttacatagtcctcgtggggatttggcggtatacatcgccctaatatctgagctatgattgcgctatctaacccaagtacttttatgaaatctgaatcggcgtccggaggaaggccattgtccatataattggttaagtaagtcatgccgggaccataactttccatgagtccgaaaacgatgtttccgatgacagctatgcatccgataacctgttgtacgtcgtcaaatgtgtcgagttcattaacagtaccacgagtttttcccaaatttgcctttagcgccgattcataaacccggcatgcctgtctcacaaaacctctttctataagcgcttccaataactgtctcggcgacgaactgtgttgtacagccccccatgcccgcctagccgattcggagagtttcgctttagcagcatcgagagcgcccccgccgtcatttaagtcgccatcggtaataagccggaccacggcagacatatggatcgctaaggcatcttctgttaatgcgtgatcagctaatataatgtctggtccgttccgcaacttttccgctaccatacccggctgaactgcatatacatacgggtctccgtatgctatggcggcagatgctctaacatcatatgctgttcttttcatattgtttgcctctacggccgagataagttcgcgcgagcccaatgcgctggcatcttctgcgaatagatcctttaactgagaaggatggggcgatcgcggacttttaaaatattgatcgacaagggccagcgtaaatagtattcgagtgagtggcgtaaaggccctatttgttgtacatcgagacataataacaaacggggtgatccacccgacggctatagaaattaatcgaattccttcctgaacaaacgggaaatcgtaaataagtttaaagcgcgtctgcgtcaaggaagctggtagttccaaagcattaggagcaggttgacgtccggataacaacccttcggaagtataatcaaacgcgtccgtggcgatctcttcaaaaattgtcagccactcacttattaggggccacaaaacactcggtccaaaaggacatgatctgcgcagaccgtttcgggtaagccacgcaatggcttcttctcccgtcatttcggccgccaatctacgcaacctacgagaatcgtctttccaggacattttatcccaccttacggaggtacgccacaagatgaatccgacaaaattttgggccagcattgccgcttctgggcttcctgtttgtttgtagacctcgagcacagccgcgaatgcatcgcgccacgtcgattccacttgctgaatactcattgtttctagagcctggaaaaatgatccgatagcagttcttgcttccgcagctgtagcatttccccacggttccagtggcgccgttccagccgataaagaccttagtgtatccagtaaagttttcaacgggaatctcgcttcgccctgggtttcagacatggcgcgccaataggtagggatggatctacgtatgtcaatggaggccgtataaagcttcaataataatacgttccctaaaatgctgtgctccgcaccgcagaaaaatatcgtgtgatccgcagttacaccataccgtactttatcatctccatgacgcatcgagatcccgtataggccggcccacgtaagaggcacacgcgctacataactttgttgcgtttaactacaccgccagtcctgtattgcagtatactaggtgacatacagcgatttttatgtgcagtagtgcacacgcagttgtcgcaaaacgggcttgcaaacgatcatcgccaatacaggatctctttataactggttgttgatagtggacgtcatgaaaaccacttttcgaacaagcgacgtgcaggcatccaacacgcagtcaaatgcctcggacaggctgcatgacatcttacggagcatcaataactcaatgcactccggcattgttcggcgcatcaacataggctatccgcatgcgggcaacaggcgcgggacgttgaccgccggattggaactgttgagcaatacgatcacaacgacccctcccggggcaaacatacaccgctccattgcaaattcggcaggcgaagctacggcaacgatcatacaatctttacgaacatattccggaagtggagatctgaacacgaatggtgataataacgtcctttcccgacagatcagcctgacagatttctgtttccccgatgcggagatgccaggactaattgtcttatctatgcgacatccactggatataaacagcgaagcattatacagcacacctgccggacgggacccacgggcattggagtcagcgtggtatgaattatctgaactggccgcggtatcggtaaacagattagacggaagtggtgtccggccgtccctattatcgctctcatttcttattgcttcccgcgcgggagactatgcggataaatgtggtgctgaggctgtaagagctcacgtgattagcaattacggccgccggcggatagaggacaggctcgacaggttcggaagctgccaagcagcaatgttgagatgtcacgtgttcccacaccgacatatgcaagtattagggggaatggtgtcgtggatcgcacagcgcgaaatcgccagtataaccgccgtggtcaagggctctcaagagagcgccaggacagaacagaccaacaatccaagatcgtcggtatacgttcccgcatgcgcctatctcgatttagataaagagattcacatgctccatgatgacagagcttcttcgctactatacctcgttttcgtttatgcacaacacctcggacgcgagagcatccgtgtatatctcatgcggagtcgtttaggggaatcggtgttcagagaaggcctcggttacctgtactccgggctaagagccggtaacgctattaacggtctggccggtataatagcgccacatggagtagacgcgaatacggaatttccattatcaaaagctttcgaggtacacaaacacgcctgtcgaaacaccggaatcggacctcgagactccgagaaagtggactggcgtttagatctccgaggccgccctacaaagaattcctgcatgtacgcagcatactgtcgcgtagggcacttgaacgagtattcgatgccggcgaagaagtctgaacgttgtggcgggtctgtggaggtccctgttgtatgggtgccgggagtagtgtgggatatcggagaatggaccgagtgttatcagtagagagttggctacaccgagatccggcatcataccttacgtgaactgcttacgtttggggatgtttttgcgtcggtgtttggggaggagtcaatcttataaaaagcctatttgtggtacgcttcggtctcgcgctcactgagcaacccgtattttatccagtctgaaatcagaatctaaaatgcagcgatccgatgaaaacgaatccctcgaagcgaatagaaatttggacaccgcctcgcgtaactgtactgatgtgcaggtagccttgataatggcaacgaaattgcatcgcatccagcagcaacttgcgagcatgggatatttatctggctacgattccgtgcccgatattactacacccgtgaaagttctgcgcgagcgcattacccatctagtaaatacattgaaacccgtttgccgtttcgatgagcgcgtgtactacgcctgcggggagctggtgcatttacggatcaaatcacaggaagctacttttgatgcgtggttgatgtcgaaaaaattaagcctgaaaggcgagatcgtagataacatacagcgccacagaggtcacgtagagacggatatgctgcgcttttacggagtaacctatccctggctgaaacgactgggtttacagtcggcgttgaaatacgaagaatatctgactgagttggaagacggcaaaaaagaatctctttgccagttttttgttcggctggccgcggcggcagcaaccgaagcgtcaaacaaaaaagctttcatgtcggctttgggtaccgaagtgtcgacctgggaaacggctttcacggctttttttttcgctctcgctcgtcagatatttgtcccatcgactccctgtatgctttttttggggcgcgaaggaacctcaaccgcgagctgttatctcatggaccccagaactataaatacacacgatacccttaaagcgatcgccgacgatatagttccccatctcctagcgagaggagggatagggatatcgttgcagcatttaaaccaaaaaacaggccttatgcctgtgatgaaagtattggattccttagtgatggccgcgaatgcgggggagcgtcgacccacgggggtatgcgtttatctcgaaccgtggcacgcggacatcatgtctgcattaaatatgcgcggcatgatggcgacggaagagtcccgtaggtgcgataacgtatttatcgccctttggacttgcgatttactgtttaagcgctacgagagacacgcaaacggggagaaaaatgtgacgtggaccttattcgattcccgcgcgtcgatattggccacgcttcacggatcggaattcgaaaaggagtataaccgtttagaagcggaaggtttaggcgtagctagcctccctgtaagggatttgatgttcgcaataatcaaaagtgcggcgtccaccggtagcccctttattctctttaaagacgcgtgcaacaagcactacattacagatactcaaggagacgccattgcaggctctaatctgtgtaccgaaatcattcaaaaaaccgacggaaatacaaacggggtgtgcagcttagtaagcgtcaacctcgcccgatgtgttttcgacgagaacggagagaaaaaatttgatttttccgcccttagacgcgccgtgcggctggctacggtgttcgttaactcgataatgtctagcagcgatgttccgactgcgaaatctcgttccggtaaagatcgacacagatccatgggcataggcgttcaggggcttcatacagctctgttgtcaatgggtctcgatttgagcgatgaacgcgtcaagcccctcaacaagcagatttttgaattgatgttgttagaggccatgacggtcagttgtgaattttgcgaaggcgggttgcccgccttcgccgacttctccaacagctattactcacgggggcgcctgcattttgatggctgggcaaacgtaggcttaagtatgcccgaagagtggaatgcgctgcgggagagaatacaggcgtccgggttatacaatgcccagttcgtagcgttgatgccgacagccgcatccgcacaagtaaccgaagtgagtgagagttttttgcccgtgttcagcaacatgtttaacaaagtgacgacggcgggggaactactgcggcccaataatcaattaatgggagagttgagggagatctatgcggataatgaggatcggcgattgaaagccatagcagcgttggagtgcgcgaactggtgcgtggagaccgctctgggaaataagcccgaatgctctcaattacttaaatacaaaacggcgttcgagtacgaccaatccctcctaatagatttgtgtgccgatagggcgccttttgtggatcaaagccagtcgatgactctgtttgtgacggaagcggctgacggaacgctgctggcgtctcacgtcatgaacctactcttacgcgcctataaagccggcctgaaaacaggaatgtattactgcaagatacgcaaggcgactaatgccggagtattcagcggtaacggcgaattgacctgctcgtcctgcatactataatctccaagcatcccggcattttgaccatggccacgcaagcacgcgggaacgaatttgtcagcggccaaaccgcacctctgcacaaaaacccgtgtcccgaaaacgcggcggccgtcctaaagatggaaggtatcgagatcgaaccttcgactagttccgctagagataattacaaagtgtcacggtacttctacgtccccgaatgcccagatatagggcacctccgagctttgagtattatgaaccgatggacggagaccgaatttgtcgtcgccgaggatctcggggacgtcgccaagcttagcgaagaagaaaaaaatttctaccgattcctctttacgtttctctctgctgcagacgatttggttaaccttaatatagacaatctgttaggtttattcgaacaaaaggatattcaccactattacttcgagcaggaatgtatagaagctgtccactctcgggcctatagcattattcagctgatgttattcgacaacgactcctcggcgcgcgcaaaatatgttcagtctgcgttagagtcccccgtcatccaatctaaattggaatggttagaccgacgtatactagagtgcacgtctataccagaaaaatatatccttatgattttaacagaaggcattttcttttcagcatccttcgcggctatcgcttatttgcgcacgaataacctctttgtcgttacatgccagattaacaacctgatcagcagagacgaagcgatacacgtagaggcgtcgtgctgcattttcaagaattatatcgctggcaacaagccatccaccgctcgcatccaagccttatttagcgaagccgtcgacttggaatgtgcatttctccgcgcagccgcaccacgcgactctcgcttattggatattggctcaatctgtagctatgttcgttacagcgccgacagattattgagaatgttggacgtgccaccgatttacggcgaacccagccccgctgccgactttccgctatctctaatgtccgcttcaaataatacaaatttcttcgaaagaagaagcaccgcgtactccgggagtgtatcgaacgatctttaattagcctgtgtgcaactgtactttctacccctacccacaagaattaataaatgaattcaaattatcgcttttcgcaccgtgtagtttgtgatgcatcccttccccagtaccttatcagcacggagtcgaaaggccgtacctccgggatacaccttagaaatgcggttgaaataactgaagcttcggcctcattgggtatactgcgaaacaccaattcttcaaccgctacatcgtcacgtatatcctgcattatggggaatcgttttaaaatactaattctgggcgttctgcgctcgggcattatagtcgcaatgacgtgctttatgaacttgtattcgagaacttcgcatctcgtttttggggggtgcaaagatcttaacaagctgtaattggacgcgagatccctgttcgcatcgggcatatcagccggtctctcgtaatgatggccgcccgtgatctcaggattgcaacaattcatcaacgacgaccggccacgctcgttatcgctcgctttaccgcagatagtgcccgaaccctgcttcaatgtccctagatctattatctcttgcatggatttcagtgtgtgttcgcaatggaggtctgtttgacaccgaacgaagttagacaaaaacgtgaaatagtccatttttaacgccgccaaaacatctctgcagtagatagtcggcggaaatattctagtaaggtcgatgattatatcacatcccatcaatagcatgtctgtatctgaagataacacatacgcaaccgttttggtgtgaaagaggttagcacagatatcgtccgcttccatcatggccacatcgacataagggtatcccatatagcgaatggtatccatgcagagcctatgtagaattttgggcgtatcagacttatcgctccatctgcgtggtcttttccgcttccgcgttcttttgttccgcgcttctccggtatccgcattctcgcattcgtcgcgcgaacgtacttgcagcctcccagaacctcctcccctcgcgatgcgagtagctgctagcgcctttgctccataaagcgttttcccatacttcgaaaacccccggtccgatacaaacaccggataatacgaccgttggtgtaacaaacgcagcagacagtataagcaccgcagcgtggcgaccgagttgtcgactccgtcgaccttaccagggtaaattttttccagcagtccatacataacattccataaatccacggcaatgggcgtcatagccccgccggatatcgaacccgaaatgtgacttctcactaatccgttcgcataggcgaagtgcatgcaaccgtacacgcccatggcaactttcggagtcgcagtgtaagagacacggggtaatacgaattttgaattttgggagtatctgtcaagtatattcaactcttgaataaccacgaccaggcgtagctatccaaatgccgaaacgttaagccgctccataaaaccttgattccactattcaattgtgcaatagttggattagggcaggtattcggctctatctgttcaccgtatacacgctataccgtcctttaaattagacaaggtgcgcgtctctaaacctataattcccggtagcggtataagcgacacttattacatgcctatccaccacgtgatgcaacccacacgattcacgttgaagacatgtgacatttgctgtaaatatacgcaggtaacaatgtgtgcggcgaattagacttacagccaatagtaagcgcgacataacactaaatgggcggcgcgacattcgagtgcctataggagaccgatatacgtaaccacgcgtggtgcgattgcgacccaggctccttcgatataagctttccccctcacatccggagccatccgttagattgactctgcctcagcctatacaacgcgccaaagaacagtgtgctacggacagaagtgacgccgacttgagttcacggcatcgagaccccagaaccggtctcggcgatggcgcgaataactatgagcgatgaacacatcatagacgatgcaggggccacttctaacgattcgcccaattcctggaaagtcgtcttggccggagagaaatttagaacggtatcggctgcagtacgcgcaatagtagattctgtgaagaatcccctaatcatattcagcgacgacggattaatgatacagggcacgatttgcggtcagcaaacattcgttcctatcgagtgcgccgcctttagtgaatttgaatggcgcgggtccgcggccatattcctggcgctaacagattcgaggcgtactttattagacgcgtttaaatgcgacaagaaaaaagcaatcgaggtctcctttacgttccgaggggaaccgccgtcgcgacatctaacccagacagtcacgtatgtaactgataacggatcgttctcgagtgctatcatcaagtatgaactgtggtgcgcctcagttttattcccgcaaaaaattcccgatgttacgttctcagtaaacaaacagcaattaaacaagattttggctatagccgccaagagacggcacgagcaactaacatttgcgttgaaagcagaaggggggttttatgccggaactgtgtgcgatgttataagtttcgatgtagacgggagcgcaatgactcagtatccgtataatgccacgactgcggtctcgtctgccctcgtcttagcatgcgggaagaaaagagccgcccgtaatgcacccgtgactgcatatgggagcggaaaacctttctgcctcgcactggaagacacgaccgcgttccgaaacgtcgtacagaaaattaaaaccggctcggcaggggcagatttgggattttatacggcgtgcaatccaccgatgctatgcgtgcgtccgcacgcgttcggcagcctgaccgcttttctattttgcaactcggattgcatgtctatatacgaattggaggaagcgagtgtagcggtcggcgcagtaacatcgaaacgcataaacgaatattttcccagagtatcgaccatcgattcccggaaaaggcgcccgtcttcggtcctctcggagggggatgggaaactccttaaacccgacggccaataggtctcgtgtccgcgcgcggaccacagtcatgacgcggggaggtcaaactgatataagatgtgataagactgcttagatttcattcgacctggttattcggacatacatggagcccgtcgacaacgcgtctccgttacctccgactggcgcgggacactgtcttcataggattgtttgcatcgaccctccatgtacagcaaccattggcagcgggaggagcggcaataggtgcataaaatgtattatggttacgacgggctccctgttatcgatggccgcacacttgaccgtcaccgtattttgcgtttccgtgattccgtgtatagatcgaaccgcagcctatccacgctgcactatgggcgccatcttcgcattcctattcttttttaacatgcggcttactgcacgatcatcggaaatagtgctgctcattggcagaccgacacaatttttatgcgctctgacagcatcaatcgccgacacggtcgccaaacatctagcggctacccataaggattacctgacgacattgcgagcaatagaagtaatgtctctgttgacttttgtcatgctcggagctctgatcgcatcttatcattacgtctgcatagcaacgtctggagacgtgacgtggaagaccgggtttttagttgtggcggcagggacgattgccggcatcacggctccgtatggagacatttctcctctagccggctttctttcggcgtatacggcgttagctattcacgtggtcagagacgccagtcggtctctaatgaacacgtgctactaccgtgcacgtcgggaaattactgtgaacggtgcatatcgcctcggtcgcgcgcgtctcccgcccagcacggacgccgaggcgacgcgcgaagaagacgtatccagttacgatacgctgggggggaatattcctacgataattctgagcctcatagcggtcatctcgattccagccatagccagctttcaaaagtacatgtcgaacgcaactaagcaccagtcaacattgactgacacgttacgcagtatatgcggtttcttggtgggtacaagtgtcgcgatattccttccgtcgcgctaccacgaggttctgttccgtccaattcttgtattactgttaatattcggggcaatggctactaccttagccggcttcggtttacttctcgggccgacattgttttccgcgacagccgcggttctgtgctgctacacttgtataaatgtacgcaacgcgaatagcggaataaagcaattggcggccgccgcagctggtaaatgcatattaggaactgccatctcgagcatgttggtttgcgtgttaatacaatattcctgatcgcggagcgattaatttttatatcatgtgctcatagcgttctttcgaactgcgaataaaactttcgtggctactaaaggggcctatcgtgggtttatgcgctgtcgaaaacatgaaagggccgatttaaagctaagttgcgcaggcagaggccactccatatacgctctcggagacgcggctcgcacgccagctgaaatattttccccatgcacgcgtcacgcgcgttgcgagctttggggtggacgagactcttatttgtcgttttattttcgggccgcgtcctaagcgctagcattaaccccgatctagctacacccccggtcattgctttcaacccgtcaagtattccggccgatgatgggcctttggccaaagttcctgcatccccgccggcaggggagaaagaggagagccacaagaatgcaagcgacgcgcgtaggatgcctagtatagtttgcgataaagaagaagttttcgttttcctgaacaagaccgggcgtttcgtgtgcactcttaagatcgcccctccctccgacaacgaatggtcgaactttgctctggaccttattttcaatccgatcgaataccatgctaatgagaagaacgtggaagcagcgcgtattgctggcctctatggggtgcccggatcagattacgcctacccgcgtccttctgaattaatctcttctattcggcgagacccccaagggaccttttggacaagcccatcggcacatggagacaagtacttcatatggctaaacaaaacgacgaatacgatgggcgtggaaattaggaacgtcgactacgcagacaacggttacatccaagttgccatgcgggatcctttcaatcggcctttactagataagcacgtgtacatccgcgtgtgtcaacgacccgcctcggtcgacgttctagccccccccgtcctcagtggcgataagtacaaggcttcatgcatcgttaggcatttttatccaccgggctccgtctatgtgttctggaggcaagatgggaatatcgttacaccacgtaaggacacggacggaagtttttggtggtttgaatcagcccggggagccaccctggtatctacgataacgctgggcaactcggccatcgaccctcctcccaagatttcatgtctggtagcctggaagcagggaaatatgatgagtactacgaacgccactgcaatcccgaccgtatatcatcatccccggatatccctggctttcaaagatgggtatgcaatatgtactacgcaatgtgtgccgttcggaattaccatacgatggttagtacacgatgaacccaaacctaatacaacttatgatactgtggttacaggtctttgcaggaccctcaagcggcatagaaatatcatcagccgaatattactccaagatgactggcagaaaacaaagtatacatgtcgtctcatcggctatcctttcgacgaagacaaatttcaagctttcgattacttcgacgcgacgccatcgacgagggggtcccccatggttctcgcgatagcggctgttgtgggactagctttgattttgggaatgggtacactcctgacggctctgtgtttctacgcctccgggaaaaaatacatattactttcgtccgtctagtttgcggtgacattgatctggctcattatatgccccgagctcttgtaacatcgcggacgcgatttccgtagtaggcacatctcaaatgcaaaagcggcatgtcaaccgtataggtacatccggccctgcttacagtcggtagggcatatatccaccggaaaacttcagctttagactcctcaggtgatgaggaatagtatgtaaccctctagcagtacggtatttctaaaaaaaggtagatccttttccacacggcacagactaaataacgtacactacacaggttctctcgaacttcgtttggaccggaattattccctcggcagcgcctaaaaagcaaacctctagagtagataagtgtcagtgaacctaggccttctttgttccacggctggaaagctaagggacgaggtacacgcgaccccagccacgcacgaacagagtttaacggaagcgtcgtttgcgggataaggttgtcggaccccgcgggtccgttgaaaagtggctgcgcgcctaccgacgaatacgtcggtaacaattttagaaatcgaatatgactgcgagtaccgtacaatcgcgaaatacggtctctatatagctactcggtccttaaatatgtaagtatgatgtcccctactcccgaagacgaccgcgacttggtcgcagtacgtgggctgctccggatgatggacgagaccacatctgagcgacacaaacgttcgcgttcaggatgcccccggttgttatgcggttgtacgatcgggatcgctcttactgtgttcgtcatcacagctacggtcgtgctagcttcgctgtttgcattctcttacatgtccctggagtccggtacatgtcctcacgaatggatcggtttaggctatagttgtatgcgcgcgatggggagcaacgctaccgagctagaagccctagatacgtgctcccgacataacagcaagcttgtcgactttactcatgcgaaaattctaatcgaagctatcgcgccgttcgcctccacggacgccaatagcagcaacgtcttccgactacgcgatagtagaacaacgtgcgtacgccccactgccgcaggaccggtggccgtcgactgcccgaggacctgtaccgccatatgccagcggccgcgcccattgagtatcgtcgcttcgataatcagggacgcccgtacttctcttcgtctagaacgtcgcgaatattacgaagtttatacggccattctctcaaatggcagcgtgaaataaacgcgagagaccgagcattagagtagcacttatttattctatcgcagagaaacaccgcgcgcgttcaaaaaaaacacaggcggggtacgataaatttacgcggccgcgctatgtttactttatacatcagaggtcatcgtcaacctgcgcaaaatttccgttaccgtaaccgtgccgccacgatgcttgcgcacggcttttgggcgtggaccggtcggtgcctccaaaaggcgttcggggggcgtttcggggaccgtactgggagatccgacagccacggcgttgcacatatctgccggaatcgccaatcccgtcgtagaagcacaaccattcctttcaatcgaaaaagtggcagggagggttgcggctcggtccgatgcgggcgaaggctccgcatctgtgcgggtcccatttgacgtagatgccgtagtcggtgtcggggagcggagataagttagcgagcactgagcgggaggcggggagtcttgagtgaagtgcatagtgaagatggactgtccattagaggcaggcgcttcactggtctcgcccccgtcctctacccacgcacgcttcgattgctggggcgagtcttgcaagcatctaacgactgagtcacctcccttagccgcgggttggtaggtgaccgtcgacttaactcgtgcgtgtttgaaccagagcgccaccgtggattccgtgtcagcccacgtgcacgagttcatggtcggaaatagctcccccaggaagcactggaaccgtttctgttgccggagagcacgtctcaatgttgagttagccatgccgccctgcagccataccgcatacccgttaaagaccatgttgaggatatattgacagcggtaattcaaaagaccaaccaacgccacaatagcgactacaggccgcgatacttcactttctgggctgcttcgccacgcgcagcacgtccacaaagcgcccatgtgaacaagaggggctaaaacggttccgataaaatggcataacatcgtagtgtcggcccagctttccgatggtagggaactcacggcttcggcaagggccaaaaatacggtatcaaagtcgctcggggcccgagggccgaagacgttagggcacgcgcgcagatctaacacgtccattagccacaccgcccacgtatacaacgtccttacataactcagcaatagttgcaagcgtatcgacgtatcggcactaggcgccgttacatcatcgggtctcatgtagtaggcgtatttttgaataagctctgtcccgtcccgaatctctcgccaacatctgagatacagtgcattatctttcgcgagttggaacggtttcttgaccaaggcgttacgattaatgatagggtaaaagagcaatgctgcttcacgtctagtcggatcgcaggtctcgggcgaaccggcacggcatccatcgcgtctcatctctaaataattcatgtaagaggcctgataacacctcttgaccgacgcacgagtcagcttcttttttttcatacggcgcgcaatgcgcgcgcggtagggcctcgtatactcttccgaggcatcccctaacgcgaggtagacgacgatacattccggaactttgttagaaggagcgtcgcgcaacagcgtttgtcgcaaagcagagagaaatcctgaggggagcacttctacgagcgcgtcttcttgagctcggatacccgaaagagatgtacccgttgtttccgatagctgacacgggtactcctggacgcgcgtcggcgaacctcgtgaccgggaatttaacgccaacgaatccgtctccggctcgggagaagttggcgtaaacaactccggcgacatgctagcgcaagcatatcggtccatcggaatctatacagattaggcgcagtacggaaaggccgacttttgggacgcgaagtggccagaagcatcgctttccttagcacaactattcttaaatgcgatgcttactcagggcggattgatagtcccgcccatacggcgcgtcaccacgatctgcacgccgctccgtgcgctttttttttaccggtccgtttttttgaagatcgcctccttcgcatcttctaacacatcctgcagcgaggctagcgtgccgagaaggttatacccgctcggaggcggtactagctttagagcttccaactctccattcttctcctctccacgaatcgctgtcgcaatgccgtcgggcgggtctcctcgctcaaattccaattctaaatactccatagcgtcgtcgcggtcggctatatattcatctacgctaacaggtcgatacaagcctttacatacgtagcacaggtggcggtatagcttaaacgtttccgaccaaacgtctacagcgaggtcgtggtacatggcggcgatcgtgaggtgcgcgacgccgatattcaaatgccctagcagacgttgcagaacaatggtagtggctaccacggttgcggttaaggtgtctcccgactcgatatctctctcattcgccgaggtgctgcgcgatacgaactcgttcataagctccgtaagcgcagatctagtagcgacataagccccgacgaaagtctcccctagcggcgcgcccccggtaccataagaagctgattccaatctccccaggcacattccttccgcataaagaacatcgaggctctccattgggagctttttatgaccacggcctagcagtcgcgcccacgcgcgaacacgattagctttgaaacggtgaagcattcgacccgacgaaacatacaggaactgcgcggcgatactagcagccacacatcccacagtaacgcacgacgatagcatttcaagttcttctttcgtcacagacaccgtgtcagacgacactctcgacaataaaaacacttctgcccgtagcatagcggcagcggcatagcgcactgcacttttacacttcgatcccaaaatgcaacggagttctggccagtacgccagagagccgtaggaagcacgtaaaattgcagcagcggggcccttcgccttacggatagcgccgccttcaaacattttagcgtcacccgtaggaacgcgtggcaaagacgacaataatttggcgcgaccgaatttggaaaagccccctttatgtatcctcaccgctagctccaaagccgaggtaattaagaaaataatagcgtctttctgattcagctcgccagacactacggcactcctcagggcatctatcccgaggcagagaataagcgcgtgtgcttgcttcgccgtccgtttccaggcgagagcgccttttggtggcgcggacgtatacatatcccccttggcatagtctgatctgctgtcagaatgccaaagtggaccgtccccgaaagtattgccccgggtatgtagtaatttgtcttctcgtatagcctcgactcgaggcacgggttccaacagccgccgcaacggaatgaacgtgccaaggctctcgataaacgtcggactcgtgccttcgaccttgatgctattgagatcgggttcggccgataaaggggaagggaccgtgtaagcagatacgacccgctcgtaaggccgtaaatcgtcatcatctcccgaaaagctgtcgcttcccagagattgactcttttctctagacgatgcacccgagcctttacttatccagttctgttttaagtcagacggcgcacgctccaagctgctgtcgcgattaaatgaggttcgatcctcatgaccgccggctctcggtcctcgcctgcgtgacgatccgcggcgtcgtccgcgcacgcgcccagaccgagccgcatgtgtgtattccccccctctagatgatcttcctctaaactggacccatcttctggatcgatggcgaccttcagagccattcgagcctatcgaagaccggccagaacccctagaataatgcgtgcgcacgctagcgtttcgatgtcgccgtctagatgacgacctccgacgtctagacctaggtctcgacctcgatgaggcgtctgtcatgtcgcgcgacgcatcccggcctgaacgatccgaagagcgtccctcccgatctctgcgatagtgcgtatgagcactagcgttgcgatgacgacgcctagacgaagaccttcgccgtttagaccgaggtttagatctcgacgatgcgtctatcgcatcacgcggtacatcccgtcccgtatgctccaaagggcgtctatcccgaaaagtatctcgaatgtagccaataaacccttgtccgttgcgacgactcgtagatccggcagagctcctatatccatcagtctctaggcgatcgtacgtatcgtcgtagttcgtctctgatggtcccacgtgtatgcttgccatgttatagggacttcgcgataatcggacacgcgttttagttccgcgcgttacataatctcggaccgaaccggttctctgtcgctgctcttgaccgacatccccatgacggtgtagagccagcattcgccttcccgtcacaactcaccggcaaagtacggcggccgtccatcgccgtctcattttatacggtgcctaatcgaacggcggaaccgtagctatatcgaccgcgttccattgagaagggggcgcgaggaacggtaacgaagtaaatataataaaatcatttattagctgtcgcttttacgtacaacattgttttaactacaaaatcgtaccgtcgcatcaagtattacatcaccgtttaccgttcgcggcttacattgtgcgagcagcagcgatatcctcggcaatcgcgggcccgggatgtgtagaatcccgcaacatcgctttcacgatagtcccatggccacacgacgggccggccttcccagcgcggccgctctctccccgcgctgatgatcgcggtcttggagggtgcatgagagagtacacttccagctttgatttgatgcactggaatagatacgcggatgccctaggcgcgtttgctaaaaatgcaggcggggctgtcaaaggcataccccgctcttccactaactcgcatcgcatcaccggcagtccgagttcggaccgtacgtaattttgtgttcttaattcggcggcggttaacgcacgcccttcaactatcacaacgccgtggttaaaaataaccggttgaaataaacactgaaagtgtcgtaattggtgccaatcgcaccgcaggtgtgcaaataagttttgccttttcctctgactggcttcgagtcgccgcgatacatctcttgtaaccgaaaggtataaatgcatatacagaagtcttgcgaaccttgccgcttcccggtaatacgccccggcgatagatcgccggggcgtctctgacctgccgacgcacatatcgcatcgcgagggttcgttcgctccctgcctaagataacatgccaaagcacgacaataaccgcaaagtagagtgacataggatttttctctagcttccaattccatcgaaaagaatttttgaatctccgtaacataaacaggcaagccgtcctttgttaatgggggccgcgggacttccatcccgcaatgttcgtttagatttatcgccgtatatgcccatttctcttcggacgccgcatctaggacttcgctaggagagacggacagtagggttgcatgttcgtataagtgcccattaatcggaaagcacgagaacaagtctacgtttagtttttccagccgagataacagggacgggccctctgtaaaatccagttcgtgcaagagcctgttgtacaagcggttcggaggattcggatttggggacggaagcgaaattttgatcgaaaatggagcactcaaagagaacgaggcagattgctccgcgcatctcgtttgagagcaaagagtttcgctaaagctttcaatgccgcggaggatgtccgaatccaaacagtccgtcattccgtttacgggcgcttcgatctcggcggataagtccgtactgtcgcggcgagcatctcgactccccggtcccattctccgcgtcgccatccatctgcttagtagcgcccgccccactaccgatactttatgtgacgctattcactctcgctactatagttaccacgggaacttgagtagtggcgacgtgaagtcgtcggagcgcgaccgggggtttttgagcgacgatctctcttatctaccggagtgctctcgtcaccgtcgcgttttccatattgggatctggacttagggtttcccatatccggcgacagtccggactcctccgataattttcgcgtacatgcctcagcttcatccaataggtttgccccttcttgaatcgtgatcttgattatagccctggcgaggaattcctcgagctccgcattggtcctcggggcgttccgacgccaaagggaaagcgctcccctatatgcatggtactgggccacagcagctacggctccgcagaatatacgctcgttatagacgagcgtgtttgatcgccaggtactagttgctgacgccggagtcgtactaaaggcaaatttccctttttctattgccctggctccgggtttggcacgaactttggaggacagcgactcccctctttgggtttccgatgaggaatcttttctttcgatctttacagatctgcgtctttgtaatgaatgagacgggggggagatccggtccggcgactcgttcttggacgaatctcgtcgagcgcgggtcgacgatatatgggcactattatccggtgacgtgcgcatagttgagcgacgtcgactcgacttacgtctatccgaatctcccattgtatctcgtattaggcagccgattacagacgcgacgggccgttacgtttcaccgtgttgcgtctccgacactgatcaagctgttcacggcaatgacattcttatacgggaacagtagcgcccacgcccacacgatcttaccagccgtcatcgaacatacttgccgtgaatagtcggaagcatgcatggtacgacccggccaagagggcggagattaccgccaccagacctagataaaaaaggaccgagaagccagaagaaaaggctatagacacgcctacggcggaacacgtagattcccagaaatttcctgccacggcgatcggccttcccgaatcgatcgaagtagctcgcgactccacgagggacgcaattacgcaaattaacactttacagaccacatgatggatgtcggacaaacccatccctgcggtaacgctttggaaaagatgtcctcgcacgcgtcgggggctccgtggcgcatgcagttctccgtcgatgaagcgatatatgcgaggaacccagaaggttggacctgttatatagaagaacgcgacccgcgctgtcttcgcgttatcaacgactgtgcgatctcgttgcccaaacgcgatgttaagcggaagtatgaaatatgtgcgttagatctaggtgtacgagtggcagttcctcggaattatgtcgttgtgctggcgaaattgacggacccggatccaacgtctcggggcgtacccgtaatccgcgttgccaatggactaatagattctggatacagggggaacgttcgagtggtacttttgtacgaagcagcttgcaccattcctaaaaacgggctggttatacgtctggcgctcgtgcagttggcctatccggatttcaacagtcgcgtgctttttgacctcgctgatatcacgccccacttggattgcgggcctaacttttcgatgtcgattgcaaccgctgctaaatcgcacagcgctcaggctcgaccgctattgccccctggcggcgagaaactatggccgggaaccgggtgtcgggcactcgtctgtttgtacagcgatcgcgtgtctcgggcaactcattataacactttagacagcaatgtcatatttgccgtaaggtacaatgattctacgaccgttatcggcttaaaagatgtcccgaagtatgtgcataaaacatttgtacggttttatacatccggtcaatttgcaacgttcgttcctttttacgagacatttaatacaaagcggcacgaagatgcggcttacgatatattcgctccgagcgacattgtattggaatcaatgtcttctgtaactatcgcgatacagcagcgatatgcatgtgcggataagtcaatggttccttggatcttcggacggtcgtccatgaatttgcgcgggttgattatttccccatctaggtggatgcccgattcgtggttaacgctgactttatgcaacttaacggaagcaaaagcgaccattaaacgcggagataggatcgcccagctgttgttagtcaatcaggaagccgctgcgttgcttccaacggaaggcggcacggctgcgctgttccctacagtaggtaaatgccgtcgtcccgcagcgtccgcggaagctaagtggagggaaacggcagcattcgatacggaatcgggcaggagcgagagagagtgtgccggcttcgggtcgagcgggcaataatgtatagttgcgcacgattacatacaaaacaataaacacgaacaccacgctgcgttctggacaatcagtttattcagttacacagtccggtaacatgccctcgttgactccacatgtcttagcccttctaccgcttcccttacttacatcacatgacgttgcacatgccgcttgctcggcttcagagtgcggcggcgaaggtagccctcccacccgaccgtaaatatctgctccactttcgtccccgcagttacgggggtcagtagcttccgatagctctaagttttccgtttcgggacacgcggccaacgcttcgagcgagcaatcatttggggaagattttaagcctaacgctctttccactagagcgatatcattcatagcagtctctgtagcagcagttatttgtatcgcgtgttctacgaaggcatccgttcgtcccgtgccgacagacatgtagatctgcaagagggcggcggcacacgtgtccaccattcgctgcgcatttttgcgatgggtctcgacgaccgcgtcgagcccaggggttccttgtcccgaaacatgacgagataggcaatcgagattacggagacacgcactgtacattctagccaacgactggccacgaaccagttttcgcactccgtcggcagacaatatcgccatttctaatgtgatgggcgtggggagcataagattgacggcttgtaccgcctccctgaaacgatgcataactctgtcggaggaagacgaggtagacagtgctgtgtattccggctgaatttttctagagcgccttcttaacccggcgtgcattgtggccaaatcttctattatgtccgatataccggaggatgccgaccctgggatcaaagttttgtttgccgttgatggttgcgccgtctcgttctcccttgcacttcttacgggtcaggtcccatctatcaatcccgtctacgttatcagccactgggatccgggcaatcgtttgttagatgtcctttgccaccgcgcagacgatcgcgactgcggaagaataccgaatgaacgaggagatttaaacgcggtctccgaccctctaaaagtagagttttgccttctcagtcaaatgacacgcggtttgggcggcgccgatttaaaattgcggacgcgagcgatattcgtgtgccggtttacttcgcattccgagattaactccatcgtggcttctatagcttccggagcgcctattcaaacagacttattaatagccaccctctccgaatatgacacatttcgcctacatgatgacttcaacatcgccctccacatctctctcgcctgtttatcgcaaaagcgccgcaatgggaaagagccggcaaaatcaccggatcgaaatctgctatcgattatggcgggaaccttttctggaggtcggcgcggtctagccgggctgtatttacaatacgagcaaaaagtcaccgcggcctaccgacgtgtatatggggggtcgacgacgacagcgttctggtacgtgtctaaatttggaccggaagaaaagagcctggtcttggcgctacgttattaccttttgcaagctcaggccgaacctactgggattgctacgggttacgatttacaggccataaaagatatctgcgacacgtacgctgtacccgtagaggccaatcctaccgggttttcgacggcagacttgacatcgtttgccagattatcgcgtttctgttgcgtgagcaattatgccaacggtcccgtagctagggcgtttcccctatacgtggaacacagaattgcagccgacgtgacagaagtggatgcattgaaagagtatatagaaagagaccggtccgggttaaagatttcggatttggaatttgtcaaatatatttacttggcttacttcgagtgctacaatcgtgctcaattaagacgtcatttgcgagacgtgaccgtgcgttgtcccgaagaagatgtctacaaacgctcgtctctggggaaacacgcagtcgataatttctttacgcatgtgagatccagactaaacgtgaacgatcacatagcatgtaacgtatctccggatcaagtggaaatgggaaacgttttgacccgagcattttgtagggccaggacctatccaccgagtaccatggaaagcgatgcgcgtttcaccgggatttgcgaaccctcgtcggtgattataaagcgtctggatgccctagaatcgacattacacaaatacggatggccgcgcgcacggtctgaaacagttaacatgatgtcagagtgcgcgaatttgcccatcgcttcatctgccgatagtcttaggccacccggcctgccgctagaacatccaggcactcattgccggggtggtccaatgatcgtaaagcgcctactagcgctagtatccgcagatgcacgtgtcggggacataggaccgacaaacatgctcaccggcattcgggaatcggccgtcaagggccctcttccgatttaccggataggcatgtccaaaggcaaacaagcgtttgccgtgatggtggccgattgttgggacaaaatcatcccgtctccgggaattgtgaaagcccatctctctaaactcggcagatccggtagagcccccgaagacgatgtgatcgcccgagatattttttttacatcagaacttgagcgagtcacgggccatgctgcggaactgccgtactttacctgcggccctgccgaagaacaacagtacataaatcgcaacgaagtgttcaatgacaatcttattgtggggaacataatcctggatgtcgatgtgcacttacgaacccccgtacccgtcaaacttttgcatgtggcaatgagaggttttaggaccggtgcgctcaaagcgttgtctctattacttccaaaagcaaaaatagatcacggctcgtacccgtgctacttttacaaaacctcgtgcaagaaatctcgagtcgtgcacgtaaaacattggatgtcgtctactaccgacttcgctctcgactgcgacggtcccgccgtcgaaagtgcagactgcgaactagaaatgggcttcgatgacccgttacttatggatcaaattgatgattccatcagtagatgtgagtcagatgcatcaagtttgccgtcggacgccgatctgccttgtaactgtcacgaaaaaataggattgcgggtctgcattccggtgccgcccccgtatctactcgtaggtagcagaacaatgagcggtctggctagggtactgcaacaatcggttctgttagaacgtagtttcgtagaacctatcggttcgtatctcaaaaactatgatatagttgatagcggagtatatggtcacggtcgcagcttgcggcttcctttttttggcaagatagacgagaccgggcttatatcaggccgcctgcttccgttttgcgtgataccggagcgctgcggtgacgcagaacagttcgttctgtctcatttacagcctaaaacctttcacttccacagtcccatgcccgaagaagatcacgcgtctgtagttctgaagggcctaggcggagagtatgccggattctttgaaaaaaaaatcacgatcaatagagatacgtttttcggaatcagattatccttagcggtagctctgaaagccaggggggttgacattaacgactctgcggcaatcgtatcattcgtaacggagcacattttagatgacataattcagtacatgcatgaccacatacccgatcacgctgcggaatataatcacgtttctgtttcgtgctgcgtcattagaccagattggatcctcttgcagctaatggccaataaaacattgggacgcgctcacgggtttacgtgcgtgaggtttaagcatacaagaacgactcgaatgagttcgcgttcgtatttgtctttaaacatcgacgcacatggtaggttgtgcgcgtgtgtgattcagcagtgttttgcggccaagtgtggaaacaataaactccgtactctttttacggtggatgtcgattcgaaatgccaggcagaacatcgatagccctttcgggaattatactctgcatctcgacatacgccatcgctttggtgatctacacgacgatgatagctaaacacggttctgggtgcatctatgccgtcctggtagacagcgatcatcgcgatgccaaaaattttacatgggagccatacaattctacactggtatacacgccgctggggaataaattaccattggacggaggatttggcggttttagcgatgtatgtaacacatatctgatcaacgcgacggatttattcggacgcgcgtctcacgcgtccgccaagtcgaaaatccgttcggtggtaggaacgcgcaattgcgcagcctacttttggaagacgcatatacaagccttgaccttttccctaagttcgtacattatgttttgcgtcattagagaatggagacgcatgtttggggtggtgcgatctgaaaacgacagaataccgccgacgacgtacacgaagaattatactgccagggtaatcgctaacggattgctaaaaacggtatatactagaatgtctgaatttatgtgcgagattactatatacaaaaattctatgtgcagaatatttacagacgaccctatctcgtttatcttacgtcaccctttggctgcgattctccttataaccgagcggctcataaggctcggcgcacagtgtctgtgtgtactaacggtatcgattttttttgtaccgtgtaaaatagttttatcgaaatggttcttgtctatcaccggagttttcttaggaatcgttatttgcaccgagatgggcctgctgatagacccgggaccggctgaaaaacctgtcatgtttgcagaagttgccccagcccccaaaacccagcagaacggcgtggctgtcccgttcggtgcacacgctgtatgttccaattgctgcgcctccataatctccagcatagtcatcaaagttctgtacgtgttattcatggttaccctcatcgttaccctcgtgcgatatgaacgagcgctccagattgccctgttcgggcgtgcgtacctaccctaaaacattagtggccaagcctcctatttgcatcgcgcggatgtgacacgctaaccgcgagaccttataaatggttccaatgagtcattcgcccctcgggtgtacgcggtattctacagcagcgtattagataaactacacgggtttgccgtcgcgcctcaaggaaaatgtcagtgggagctttctctcgtgattgggacgatataatgagtttgtcagactacgattttacagaggaagaatccttagatgaaagcggcgaactgaaagaattcaagaacacgtccgcgttgaatgctattgagacagcccgcgacgcaattgaaagatcagccaattcaaacccccccatcgaagaaccgtcgttcatctccaaatctcatgcaggcgagacctcggcctcgaaatatagaagcttgcccctcgacatcgaaaaggcagaacggtgtgatgacactcgaggctacaacgtgagttcgggaaaacgaatgcgtttggcagtttcggccactgttgacctgtgcgagtctgagatcgaacggcaatgtctgaatacggaaacgcgggaccgtgcacggtcccccaaacattttgcatcccattatgaaatcgccgccaaaatacacgatcttcccagatctacgggaaaaaggcaacggcatcgcacgttagattctcgctcacgacgccacttagcgggagagcatcggcggcggggagctcatgacgaggaaagcagacacttttccctcagaatgcgtgaccctcattcagcacccggcaagagcccgctgtcgaaaaggcgcagtcccgttaggctccgtaacctctctgtgcaggaggaacttaacgcgatgctacaacgagagaaactgaagctcgacatgatttcgagagagcgcaatttccgcacttctagcaaaaaccgctgggcctcagtactggcattctcctgtaccggaaaaagtggggcatacgggtctcagataacgtggcaatatttgcttcaagagggaccggagcttagaaagacgttcgaaaatagacctagaacctcattgctggcgtctgcggcgcgcgaagctgtgttgcggggcgaaaacttagttgcggcattggagagcgccgaggaaaccctggcatggctgaaattacactctgttctaaaactgcgtttaatgaaccatgaccctattttcaggacggcgggtgccgtcttagataatctcaagctgaaactcgcacccataatgatgtgtagaaatggtacagacaaacggtcgttaggagacatgctgagaagatccgccacggacgatatcgccgattcattgaccttatgcttaattttgctatcgcgtattcatcgcatgatgatgtatcgcgtgtcgggtagaaaagatagttccatgatagatcctcggggatacatgagagagtatactcctggtgaatgtatggcgggtatattgcattacgtagacgcgcatgcaaaaacgtgttccgacagagcgtgcaatttatatattagctgtacccttatgcctgtttacgtacacggcaggtactttcgatgcaattccgcgtttgatatgtaacctactacagacgggcaattttgtattcttcaatagctttatttgatatccattaaacttaaataaagacaccgatattcaattggacatgaacagcgtgcgttttattttacacttagcctgtgtgctttcgacaccgagtaggaaaacgaaggacctgaaattgcacgcacgaccgaaggaaataagccatcgcaatcgcatttgaaatccaagtaggcaaattcaggagaacctatcacttcattgaacaagttctcgagtattcttatgaatgataagcactggagcccgccagggcgatcgcagacacaactaattaacatgccgtgagtgctgaagttctctctcatggcagattcgcataagtaaatagtcttccttcgagttcctatctccgtgaatctgcgggggttcatcagaagcgcaggtttgatttccgacgtgtgattagaatgaaattgtcgaaagacagtctttagagtcattggcatgtctgtcagtactatggacacttccttgcggcagcgatcggtaaggaaccacagtagttccttaggtagtatgtttctacctaggaaccacggtgttcccacggccaaaaaccaagcgtggtcaaacgatccggtgctcggagaagaacgctgcgtatccgctacccaaagcagtatcctttcgcagatagacgacgttgccgtgaccattctccctttccaacctcccgtcagtacactgtttattgggcccccggcgtgcgtgaggagtaccggtctagcgactattccataaacgttagtcggtgagagttctctcggggtgagccacattgggaagcccgtctgggttggagcgtccgatgtagagtcgtaattggcgcagcgctgaccctgcggtctacaatgcatggtcatgctagacgggacaactagtcgcccggtgcatttttcattacggccatcccttacgtccacgtaccacgtgccgtgagtgtgtaggtaacacgtagtgggcgtggaaaaacttatataacacccggcagaaaccacgtgcgcccagcggtggcagatcctcagttctacagtgtccaatggcggaaagtacagctgaaccgtcagcttcaccggtacgaattccgtacgtttggcaagtgatcgctccgttagcaattgacgtgccgtccgcctctactcaactagctacgggcgaacatgtgtcatgtgccgcatccgttattcctcgttcgtacgtcatacgggcagcgtgtaaatcgtcgacgactttccacgcgttcttctttggattggcgacggatccgtctgagaacatgtcccaatgcggtgcctcgtatatcgcgtatagaatgaacaagaagttacggactggtcgattgacaggcgaccaatgcgagtcgcctttttctcatgcgacgatcatcgactcactggatgaaaactacagcatggctatagagggactgtgttttcattgccactgcgaaaataagttttcgctcgagtgttggagatcggcttttagcgctgccgaaaaaatcgcatcgcagtgcagagctattcgcgagtacggacactgaataaaaacgaatcatgatttgatctaccatttcagcatttattggtttatacattctcgggttcgtatgtatacaaaatcttatggcaacccgcgataacaattcatttacgcataccaattgcgagagctaggggcgcaccctcaggttcgcctacgccggtatagcgttgagatctaatacgggagtagtgattttgcaggaatgtaagtggtagtaacacctaaagaaaaccacatactaacgctctactgttcactcgtatctacgtgcagtgaggttcccgcatatgtttgcgcgtcatcaatcgctctcgccagtatcgccacaatgcgtttttcgcgcgcgggtattgggacgcagtgtaagtggaatagcattccgcaggcaaaaaagttgtttgtcatgcaagcatccatcaagtagcaatcacatagtgggaccagacgcctcaaagcgacgtagtggggggaaccctcttcccattgcaaccactttcgaaatctgtaggtatatgctgccagccagcgccttgttctgacggttattaccctgaaccccttaaatgggaagaagaatccaaggtaccaatcgttggcgactggcccgtgcggacaacgggttaaggatgtgacaaactgtgtttgcgtgggtacgtttacgatgtatttcgaatcccgcacgacgcattcctcccagtgagatagtagtatcccataattcatgcatctgactaccttgggggtgagacacgctgtaatatgaggcgtcgcttgtaaaacgcacctgtatggaaccgttccgagttcggggattgattctatgatagcaagtctacttattccggaaaccgccatgacatcgcacaaaggaagcagttggttaattgcatgaatcagaatgtttgtttccagcacggcacctccaaaggaaaataatgtttcgatgcacgttcgtgccccgttctctgtattacagcttactagcgcaaggctgaggacaaaaacgagttcgggctttgtatgttcgagcggaacaccaatgcgacataccgtatcgcttaagtttttcataaaagtggatcttgcacgtttgccagatctgctccaatcggccgaaaaaaatttgcgcacaatcggatgcatgtctgtgcctacaaataccatgaaacataattcttgtgctggacccccatccccgctatctatatctacattgtctgacatgtgttgtgccgacaacaaacggtgtcttgtatccccatcaatccagcgctttctgaggtttacgggctttaggatggacacatcaccgcatttcggcacgcataacgcgggcatgtctgaacgggcaacgattctctctgtgagcagatcgagacggccgtgacgcacaccacgtgccggtacattaggcacgactgtagcaaaaggatggtagcgatggagccagcctaccgacagtcccgcaaaaaatcttatcggcggaatgtctcttttaaggggtagtgtgttacgaaccgatgaattcaatttctctgtccaaccacttatcgcttccgcaacagaaaaatcgtttctaagttgcgaatatgtttctaccacccacttgagatcgctgcgaagggcttccgacatttttttagcgtattcctcatctccatcacaatcacagtcgtgtctttcatttgcaagtgtgggcgcgcagatgtctacgcgacgacttaaccgagacactgtttctctagtgtaccggtaacatggactggcgcccgctctgaccgttagcatgcgtttggatgcaaccgaggttagataaacgtctggagaactgcccaattctttgctttcactggcacatatccaaccgtatgtatcctctgtctgtcctgccgcctcaaagttaccggggagaggtccgggactcgctagacagaagtcgatttgggaaaattctgtgtcattgttgtagggactgtgcggcctatctaccatagttgcagaatcgtgcattagaatttcagcgagcatggaatcgatacgttcgtcggcacccgcatatacggcacctattcctattcgcgtacaagagtcatcttctacatcaagcttccagaacgttgtcaggtattcgccataggctgcaaagtctgcatctgtggttcttcttacaaattcaatctccgggttccaacgtccacgtcccatacataggttgcgcaacgtgatcgagtacgccaacgtattgaaatcatttatgctagatgcttcgctattatcttcgaacaaaattatcgtatacaatttcgattgatgcatcgatcgaaggactgacaaatctgtcgcatatgtctcctcggggagaggtgtgacggtgataggctcgtccctacgttcgaaccggataaggcctactgtagcggtggtttcagtagtcctgatgcatcgtaaaattgtggcctcggttctaattttcccgagtaaggcccacggaggtccgcaattactattacacagggcctggattacggaggaagtgccagttggtgcacaccgaaactctggaaaccattccttggacggaataggagggtggaatttttgtcgtttagtccactccatctgttcgtacatggaaaatcgtgttaattcctgatcgtcgaaatgtgctaatggagctatagtgctgcgttcggctggtgcggaacctatagacacgacatattttggttgcacgtgcagttctctgagctgattaggaaataatactgcgtttgatgatagcaaagacctttcgggatcgagctccggagtgcagtgcgaagcgtgaacaattctacttttcttccgagacggtgtgaagcaaaacatcttgacgatgctacgttctatggcattctgcaacaataaagtatcaaattattttgacattatcatctatagtatgagcggtgtgttatataagaggacgaaacacttgtgaagtagacacgttttattcaggaactcacattttcactactacgctgttgtgagcagagagataagcgcggcggaaaaaacagtcacaaatactactgttaatataatgatcgcagccgcatcctgtcgggcattaaacaaccaatcctcttcatcattagtttccgaagagctagtctcataaggcggcggaggagagtcgtaggtaggaggtggtccatttgaggcttcatacggaggcaaatatgcagcgtcgcattgaccgtcccccagttgtaattcgaaatgttcatataccgattccccgggagcgtctaaaaatggttgctcctcatgtaacgcttgcgcttcgctcgtcagaccgcggtctagctctgcgctcgtaagttcggtttgcggtcggtcgctatccattttccctcgcccgcagtaactgtgtcgatggttcactactctcgaaggagttaaattgcctactttctcctcgaatctcgaatgtggctatgcagcatcagggtcattagcgtcagtattttcctctttggagtctatggctctaccccaaatacctcccgcgattgctcctgtgcataaggccataaacaggccggccctctgccaacccgttgaatccaccttcactgctctgccaattagtattcctgcaaaaaatgccatgcatgatcccattactaatgatcttgcggaccgaataagcgtgattaccattaaggagcgcattgtagcattctcagattccacagataaaacagtacgaggtactgtaggagcaaggcgctgacctacgaggttttgttgcacctttcccgctcctttttctgctatcatcagtaagttaatggactgcacgatttcgctttcggcccggaggaggcggcgggcatcttgtaccgcgcgctcggcgcgccggagcaggcgcgcgtgcgcctcgtccgcgtccgcgcccgcgtccgcgcccgggtcgtcgcccgggtcgtcgcccgggtcggcgcccgggtcgtcgcccgcgcccgcgcccgcgtcgtcgcccgggtcgtcgcccgggtcgtcgcccgggtccgcgcccggtccgcgccctccggcgtcgttctctccggcgtccgggtcgccccctccgtccccggctccgctctcgcgctccgcatccctctcggcgtccggaggggcgcgcggatcagcggtcgggtcgcgatcgcgtccgtcggatcggcgccttttcccccgccgcatcgcgttccgccgggccggtcggacgggagaagaagggggagggggggaaggaggagaggggggagggagggtagccggccggcctgcagttcgggaagagcgggggaggcgccgtccgaggccgccggggaggaggttgtggggggcgggaggatgtgtgggggaagggaagggggagacggccgaaacctacgcgttcgccgcggcgtccgatccgggatcgctcccgacggggctctcgttcggcgatcgcttatcctctgccgccaccttgcgtccgttcgcgggaagcgccggaccggcgctctaagcggagatccggcgcctccgcttcttatgaccgggccggtcgtgagggcgtaacgatcacgtgatgcaatgcaaacgagcggggcgaacgcgtcagcgttcgcaccgcgaaccaatataagattatatatataatatattattggcgcaaggtgcgaacgcccgtccgggccaatcgggaagcgggatcctatgccacgtgttcgtgtccggccgcggcccgcgccgggggctagaaacgccgcccccctcccacgggggcggattcggggacctccggcctacaaatacgcgagcggaggtccggcggggaccgtcgttccgctggccggcccgccgtccgaaagcgcgggaccgcggtaataaagcgcccgccgtcgcggatcggattttctggtcgttcttttaccgccgggcgaaccgcgcggcgaacgaacccgtcccgttgggatcgcaggcggccgggaagcgatcgcgcgccgtcccgagaacgtcgtctacggctcgcgttcgcgggggtcgccgacgggtggaagggggatgggtaccgagggcatcgaactggccgagctcggcatctccgccttcgggccgcgaccctcgcggcgtccggaaccgtcggacgtcgagggaggacgccccatcgttctcgtccgcggatcgtcccgatccctcgcacgagaacgagatccgaccccgcgtcggcgacgcggccgaacgccgctcgcggaacacggtcgcgggtcgccccccgactttccccccggccccgcacccgcggcgaggtcggaacctcgggaatcgattgaaaacgggccggtcgagataggaccgctctctcgttcggaagcggagcaataaagccgttcggcgtgagctcgggatgagtctcggacgcgcgtcggtccgtttctgcccttgcggcgctctacgaaagaacccgatgaggccgcgttctgttcgggagcggtcccgagctgtagggatcggctcagtagtaactcgtctcgggtttcgatcgagttctagcgaaccccgaaaggggggtacgaggaagcttgcggcctgccgcaaaaagactccgaggagaatagcttatccgcgatacgccgccccctcaaccgttcagcactcacttcggcgtcagttccgaagtgactttgtctggccggctcggcgcgagccggcctcggagagaacgcgtacatagcgatcgtgggctgggcaacgagataggagtagagggatggggaaaaagtgaagtcccgcgctggctctggacgaggcggaacgaaatgggggaggggacggcctctcgaacgagagcgggggtggggcatggtcggtggaggggtgtgggaaacgccgcgacgccgcggcccgtccatgtggtaatgcggggaatagagttccctgacggggaggagttgtcagctcaccggtcccgtgatcaacgcatatgccacatatatgcaaccccgcgaccctctcctcacgaacagggtagagggtctcgctttgttgcacacacaagcacactcacttttgcggcgacaatgaaaatcgtgagcccagaccaattgcccctatatgtgttaacggcctccgacggaacaacggagttcagtattcgagattggtcgctatgggatcgggatccggaatcccgtgcaggtacgcaccgcgggctccgtcaaacggaacgctctcttttggagcgatgtcgtttgggtccgggcccgagtagggttcggccggctatttccctcccccccccccccccaagcccgtgcgggaccgaggttgagtgggaaggtctcgcctgccggatcgggggggaggggaaaagacgtttgcgttatccggaatcgagccggaccgttttacgtttcagagttcgaacacgctctcacgagctgcagccaccggctcaagccctcagaccgcgtccgcgccccgggccagcctagcgtcgcaaacgtctggaagagtctgtggagtttggtttcgagggccgtgcggggaaacgcagagggctcctacggacgaccggaggagggagacgccgaaactgccgtgtaaacgaatgcttagcggagccgcgcccgggacgcgtcgtttcttgcgaaacggggtggatcgctcgcccgctcttagccctcgcgtacagtgcgtcgatcgttaaggtgtacgtgcgtgtacgagaccgcgtgcgagcggtctcgtcgtagtgcgtatgaacgtgtttattaaaaagtctttctcgcttcggtcccgtttcggtgtctggcgatggcgcgggcgggggagtccgtcgcgtaagtcggggaacgtactttgtcctctcctctcccccgaggcgggatgtgcgagggggggggcgacgggcgaccgggaatgcgtgcgattagtgttgtggagaacgtaccgcgccgaggcccgcggtgcgcgcgaagggttagttgggggaggggcacgcgcatcataagtcgctcgcggatcgtccaggtgtttgtgcgggggatacagtttcgcgacggggaggagccgttagctcaccggccccgcgggagacgcagatgcgatataaacagccccgcggtccacctccttgttcgcgacctgctacttagcctcgcttcgttcccacgtataagcaccactgacttacgcggcgaccgtggaagtcgcgagttccgaccagtgtcgcgtatatgtgttaacggcccccgtcggaaccgaattccacattcgagatgaagtgctacggaatcaggaatcccgtcccggccgcgcgcacacccacacacacccccacacacacccccacacacccccacacacaccgcggctacagagcggctgtcgtagtacgtataggcgcgagcgcgaacacttgcacggactctcgtcgtagcacgttcaaatcggtttattaaagccctcatgctcagactccgtgtcgatggcgggggggggggggtggtgagtgacacgaacttactttcctgcgacgctcccgagaggaggtgtgcaccgggccgttttctccgagactgaaaagagaaagaaaagctccgccgttcgcccggccgagcgcccggacgcaccggtgtccgtacggccttcggacgcttagagagcgcgggcgtttcgcgccgctgcggcgtttaggcgcgcagcggcgcgtttgcaaaaaaaaagaatgtacggagagacccgcccgccagcctctccggcccggagcggaaacgccgcgttatctctacgcccccgacccgcacatccgaatgcgcggtcggatcgcgaggttaactccctgcccgcgcccgcgctccgcgctccccctgcgttgtttaccggttcgcgatcgcgatcgcggaagtcgcagggccgacttccttgtttacattgaatacgtcgacggaagcgcaactgcgtatgtccgccgcgcagacgcagaagcgccggggccgaatccgggaagaagagtaatacggggcttctccagcgcgtaagtaccggcgttccgggcggtcggcgagtcggcggagaaaaggtggatcgcgagcgcgatccgaatccgcgggccgaggggaaattcttcctatcccctgtgcgttgagcgccccgtgccgtgccgcctttttccgtttccggtcggactcggagccttcccgccgcacggttcggactcccccccccccccgcaacggttttattttcccgcgttcgaccccggcgtgatgtccgcttttctgttaaaccgtgcgttcgtcttatagggaagccatcttaattctgacatgcgcgaatgcgtctttcccccttccaaggcctaaccccccccgcgctttctcgtttccgccgtgggccatttatcttcccccccgcgtaaacaattatccctcccccgcgcgtcctacttttcttctgagacctatcgcctttggcgattctagtcagattgccttttatagtcaagtttcgagcagatcctaagcaagcatgccctgtaccccaccccccttctaaataaatttccgatccctggaggtttccggagtatttgtcccaggagcggggtcctatgcagtaatcgtaggtctttcatgtatgggggggggggagggggggggagatgcgaacgcccacactggtgttggttcgtccgccacggaagctggaaccccatcggacgtctcggcgccctgtttgcaaaatgtcaggtacttgtagtgcattccacgtaggaaaatggtcgtgaggggagggggggctgagtttttctgttatgggtatcctgaggggtctacgtgaaagtgactggccttccgttttcccacagaaacgttgtgtggtacggtgcaccctgagagatgatctatattctcaggaagttccgtgcccgaaacgctctgaacgataagcttctagattgcatcggggattcctctgagaagagcgggtggggaaatacatagccgttaaagtctcgcggtccgatatccccgtttggccggtggatgagtcgcgatggccggacggggccggaaatgcgatccttcttttgcgggctatttgcgatggaagggaaaggcaaaccggaaaacttaaggccgtttggtgtgtttttcccttccatcgcaggtcgtgccgcagtacttttgaatcggagggagacgtcgggcgagtgggaatgggcatcgcggggtcatcctttattctgggacgaccgcgaatctacgtgtcgtctcagtctggacggcccatggaaaaaaaaaagagtcgagaggcgtggggggggggggaggcctgaacggccggcgcgataagggatacgtggtcaatcttggcgattaagcctagatattgcgcggggagtggggcggcggtccaatgcctagaagggcattattcgaaatttggagtcgggctgcgtagcgacgggtggcgcgcattaatacccctatcttttttttttttgcttcgtttcttgtggccggcttgggaaatgtcagcggaaaacatgcacccgctgtgtgaatgtaaaccgcgtaagtaaacccgtgttagactagatttcgcaagttgcgaaggggggcgattggggaggaggaagtctgaacggaggggggagaagggaggggggagggggaaggctgaacggaggggggagaagggaggggggagggggaaggctgaacggaggtgggagaagggggaagaagggagggagtggggaggggggggggagaagaggggaagggggaaggggggaagggagggggggaagggagggggggaagggagggggggaagggagggggggaagggagggggggaagggagggggaagggaggaagaggggagggggggggaagggaggaagaagggaggggggaagaagggaggggggaagaagggaggggggaagaagggaggggggaagaagggaggggggaagaagggaggggggaagaagggaggggggaagaagggaggggggaagaagggaggggggagaagggagggggggagaagggaggggggaagaagggaggggggagaaggggccctggcgagatcggctctgaattcttcgttgtagatagcagacgaccgtaaacctgaagtacctgtgacttggacggtgatgagatgtttggcctagttacagggactggcctttgttagacacgatggcctttggaaacgcatccagtctgttttggcatctgagtggcgcgtagccgttgtcagatgccagagagactgaaatgtttctcgaggactctaaccgtaatctgaataggcccggaccttaatcccaataggccgtgccgggatatcagaggagagccgctcggaccgctgcgattccatccttcgactagcgacttgttatggcgggtaatagccggacgacggagtctcggcggttcgaccttagcgggccccggataggtttctcggttggggacaaaggggaggtagaggcgtcggatgcggggcgatgagcgggtatttaggccacgagatcaggtgttgtgaggaaggggtaacgacgccgtattgcggtcggaccgcacgacggcgcgtcgtccagtccttcccgggtcccctagaggtgtcacgttctaggacaaccgggacggacagggcgacgcgcgcgaaatgcctcgtatcgcctgatatgctcggaacgagtcggggaagggcgcgaaagcgagagttactactcggaactcgggactgttcgtatgttttctctcaggctggcattgcacgtgtcattgccgttgtgcaatgcctgcggagagaaagacgaattgattccccgtgccgctccccgtcgtgtgggacaaggttgggagggctctgggcgaagaaccggctgagcatcggcgcgcgcgccgtgtcccccctcggcggtgtgcacgggagtatcgggcgccgtcctcatgcccccctccgagggtagcacgcggtggtcgctgcggtcttttcaaaacaggttctgcgaagcagagatgcgtcggcgcgcgagcgaagcgaaccgagctctgctccgtccttagcgtggtgcctgagattttaacacgtatcgtctcaagtactgcgcgcaaggaccgaggcggcgttccaaacgtcggacgggacggcgcggcgtcgtcgcgcgccgcggaaatcgttacacgctccgcttcctccttcgcggggtgcttgagatcaccgaatgacgggatcgagcaccacgccgatggacggagatggcgcgcggtacgttcactgaatcgcaacgaggccgggccgcgctgcagggatggccgcgggtacgcgcgccgagtatgggggggcgcgtgctctcctacggccgactcttgggagcgtgcatcgttcgggggtcggctgttgggtaagacgtggtctctttcaggtcggtgctgttattttcggcggggcgcgggacttcgtcctgggccgtcttacacgcacgtcactctggtcgtatcggtagtcctagtggcttgcttgtaggctgtccgtcggaggaagacagcaccgccgcccagctgcctgtgcgagcgcaggactcgtgtccacgtcctgcgtgactgttcgcccgccgttcggatggtccgtggtacggtgtcctgtgttgtgtgagaggtctccgtacaccggaccatcgaaggggggtgggggggatatgcgaccgcagagcgacttttaggctgccgctgtgcagtgttcggttgggtggggagggaggaatgtctgtaaatcttacggcgatatgctggatcgtgagaggtgagtacgtgtctgtgcgggtaggtgggagcataaccacaaaaagactagaattctgcccgcggggaaatggcggtgtgtgtaatgcttctgttccaaacgaaggtgcggaataggagcgaaatggaccgaccttcccccgcgacgacgtaagtggcttgttacgacctgggaggcctagctgtgttctcgctcgttgccagtggataggctcgcccttttttgtaacagatggcgatggaacagaggttcctatgtgggggggggggggcgggaaggataacgtctatcgatcccgaagtcttcgttgcggatatgagacgatcagtactctcaccgatctgcatatcggacgcggaggggcgagagagggcccgtggttaggcgtctgtactccgaactgcttccattttttcccttacggtgcctgacgtcgtattttaacggttagatgccgtcagggaaagatgggagtttgtttgctcgagccctgccggcggactgcaggcgaagaagtagccgggcgcgaagcggctgggaatcgggtcgcgtggcgtgtcctccttcggacgagtgcttgccggggagtaaccgtcatgcactactccgggggtaggacgcgacgtgcgacgcgctctccggatcggtgccgtgctgcctgagatcgagagcatcggacggagcccagcgccgtcctttgtgctgtgtgtgagaggtcgtcatcccttctcgggcaccgcaccgaaggatggagtgggccctcgaaacgtcatccggaacgccgcgggacgaagccgccccggtaaagtccagacgcgcgcagttccctccttcgtccggtgttcgaggcgtgagacttttgtattgccgcgtcgagcaccgtgctggaggaaggagatggcgctctactccgggacgaaggcgctgcggagcgcatcgcgtggtgttagaggtggatcctgtcatcaagcaccacgtcgatggacggagactgggcgcgaagcgttctgcgggatcgcgtggaacgagggcgcaccctcggtcgcgattttctcgacgcctaccctcggcgttgttcgtcggccgagggtaggcgcagaggaaatcgcggtcgctgtggactccggtgtctggtatcatgtccggctcgagtcgtacgtcctgaaatgttgcttctgattccgacgggtcttcttcacgtacctctctatggctgcatctttatggccatagtgaggtacgtgtaggctacctgccggagaaaggcggtcccgacgaatacgcgtcccgtgtagcggtcgcccgctctgcgatgggctggttccggcatcaatattgcagggtctatttttgtggtgggcgtgaccgcgcatcgcatcgaaataaatctttaaaccggccgagttcattgttgggctatgctcggttttcggggggggggtgtggaaggagggtactaggttagggttagggtcgggcccttagggtcatggtcagggttaggcctttaaggtcatgcttaggtctttaggggcagggtcgggcctttagggtgatggttgggcccttaggggcaggggctcggggtaagggttagtgccagggtcgggtgtcagggtcatggacagggatatgccgttaaggttagggttggggtccaaagttaggcgtttaggggtcgggtcgggttcggggttaggcctttaggggttgtgtctggtttagggttaggcctttaggggcagtctcggggtcgtggttaggcgtttaggggtcgggtcgagttcggggttagacctttaggggtagtgtcgggtttagggttaggcctttaggggtagtgtcgttgtcggggttaggcctgtaggggtagtgtcgttgtcggggttaggcctttaggggtagtgtcggggtcggggttaggcctttaggggcaagctcaggtgcagggtcggggttaggcctttaggggcagggttagggtcagggtcggggttaggcttctggatcgggtctttagggtcggggttaggcttctggatcgggtctttagggtcggggtgattatgatcagagactaagagcgcgaaggcctatcagtgttaggttctctgggtcagggttaaggcctcggggttagggtctcaagggcggcgtttggcttaggggcccggggttaggacctgtcaaggtcagggttatggcctatcagagttcgtggtcacaggtgtaagggttattagggcctattaatgtcaggccctattcgggttaggctcccaccgagtactaaggttagggtcttgtaagggttggggcccgtaagggtaggggctggggtctgttacgggcagggccccccccacacggttcgacctgccacgcttaggttcccatcccccctcccccccccgagtagggttagggcctggcaggggtagggtaggcgcgaaggttgggcccgttagggctaggagcgaccctcctccccccccccattattgttagtctgttaaggaggcgttccccctccccgtcagggttagggcctgttaggggtagggtaacagggttaggttaggggttaaggtctctcggaattagggcggggcgtgtaatggttatagggtcagggcgtgccgcggattgagggtcggggccggcgagggtgtcgttccggtgtttacggaaacggcggatgtgcgcgcatgcgctcgcgcgcgagccagacggacggacggacggacgcgtctcgtagcagcattccatgggcgtttttattcgtactggccgacggcttcagcccgggtcggggctaggagcgcccgcgtgcgcgatgaagccgccgtctcccggcggcgacgcaaaggctgcggtccgcggttcccaagcgtcctgcgtccccgccattgctgcaccgctgccggaaaaagaaaaacatcctgtacgcacttcccgagcgccgggacagaggcggtctccgccagccccccgcgaaattccaaaaagccggtgtggcggactcggccatggaatctacggggggggggttgagggggggatgcggcgctgtagtcgccggatgcagtcaggacacggaaattaagcgcgtccggacgtgccggacaatcgcgtacgcggaagtgcttgcacgggaagtaaacagtggaccgcggcttaccttcccagcaggagtacggtgttcgcggagaaaactgtaaggcgggagcccatcgtcgtgcgctcccggtcctctcggaatcggctgcgagtctcaaaaaaacaggaaaggggatcggcctcacaaaaccacttcctcattcgtgactgcgcgtagcctccgttcttgaaagcggttggcgttcgcacagacctgagtcgacaccgcctacctgttgtttactttcaatgtagtgcgttgcacagagacgctcggggccgggtacaagttgcccgggtccgcgggtctgaagcacgcactcttccgttgaaggacggggtgggaaagcggattattggaccccgcgatagggtctgttagggtcgggggttcggcctgtcatcacggtcggggttagggcctgtcttattcgttttagtgcctgttagggccacattaagggcttgggccagggccgtttacggtggcggttagggcctctcggggtcggcgtcaggactgttagggtcactgttatggcctttcagggttagggtaatagtccatagtcggggtcaggacatattaagggtagcggctttggcggttacggcatgtagggctaggaccttttaatgtaacgggcagcgttggtgtcatgtatcacggtcggggtgactgttaggcctcgccgggcctcatttcacggtcggggctatggcagggtcagagtctgtggtggtgtgcttcggtcacccactgtgtccgcgcaatgctgcgcgttcattctgcctgtagccgacagttcgcggggtgcggcagcccgcgggctgagtgcacctgtggcggcgggaggctgcggcccagccgcgttaattgttgtgctatgttccttttttggggggggggtgaaatgcagggggggatattaagttggttagggttagggttagggttagggttagggttagggttagggttagggttagggttagggttagggttagggttagggttagggttaggccgttagggttagggttaggcctttagggttagggttaggcctttagggttagggttagggtgaattttttttattcagttcgccgccgcgagagttttggtatgacgtttggtggtggccagggtccgccgcgcgcatgctccctacggtccgccgcgcgcatgctccctacggtccgccgcgcgcatgctcgctagggtccgccgcgcgcatgctcgcaaatgtcgactgcgcgcatgcgcgcacgggtccgctacgcatttccgggcggcctagcgagcgcccgcgcggccggcgggcatgtccggcggggatgcagcgtgcggctcggcctactggccgcgcggagccgccggcggtcggcggtctaacgcttggagtcgcgccccccccccccccccgatcagacgcaaggctttttcaggcgcccgtctcggtcacttaggacagccgcggttcgtctcgaaaaaggtctgcggcgtgggtggtgggggaaagggggaggggcagaacagtccagagaccgtcacgggcgaacgattggggtccgcggggggcgcgaggtggactcggtagccgccgcggtccgatccggaaaccgtgtcccccctgcgctttcttcgggcccgctcgccgacgcgaatggggtgggggaggggggtgcgcgggcgaacaattagggaccgcggagtgcgacagcgggcctcggtagccgccgcggtccgatccggaaaccctgtcccgctgccgctttcctcgggcccgctcgccgactcgatcagaaacccgtctcccccgccatttttatgtctcccgtatgcgcgctcgttcccgccactttctggtgccgctgcggaagaggatagccgggcgggcgagcgggcgagcgcgccgcggaccgaaccgctccgcgggctgcgcaggggaccgcagagattgctcccgcgcgagggatcgatccgcggggtagagggctctccgcgaacagcgtaagaacagaggtgtccccgcgcgccgctgcctccggacgcaccccccgcccccccccccccggccacccagggcgaccgaaaccccctgccgccgccggcaagagtcggtcagagagcgcgaatgatgtctgtcgcatctggtcccttcattcattcattcattcattcattcattcattcattcatttatttatttatttattcgccagcgctacatctcaatcccagctaccgttaaccctaccaccacccccccccccccccccgaccttgagcggttctatccgttcgagatgaccttcacggagcggagctcgttgcaggatccggaggagcggtttccgcagccctagggatcgcgattcttcggtacagccgcgcaggccttcggaaaggacgcggcgatctgagtccagggggccacggctccgcgcccgcggtttcggttcccgggcagaccgccgtcggggacccccgggagctttcggagaaggtagggcggagttctgaggcttgagggacaatgagcggcgggtcggttcggttcacgtcgccgtcgggatccggtgcggccccgtccgactttgccgtgggaggctccattgtccgtcccctcccccctttggcggagcgcagggcgaaaggaccccgctttcgccgccgctcctcctcgtacaggccacgggtcttctaggcgctgtcgccgcgcggtcttccttttacgaaactttctctaccgcgtttgcgggagaacactacggcgaacgcgcccgcgggctcgccggcgcttctgcgctactgaatggccgggcgaaggtgcgcgcggggcattcgttctgggaacaggtatagaggcgtggccacggccgaccaatggaccaggcggtgacgcatccgcacggcagaccgcggcccgtacgactaacagcgcggaacgcaaccgagccgcggggttccgctggccccctaatttatttgtccgtctccccgctcgcggatgatatgtcgtacccgcggggctgcttgtccagatagcccttaaaagtccgccgagtgactccccccgcccccccccccccgaccctgacttagccttcactcgccgaagacttcagagtcgctgagggccaagggcgaaggaggaccgggcagcgtcggaggatgaattatcctctgtcgcgcgccctgttcctcctggacggtggtctccggcggaccgccgtccccttccagccacactacagacgagctacgtaggtgagcgagcatctcgcgggccaataaactgcacgtcgcttcgggaacgtgaacgacgactggctgggcgtgcggatcgggggggaggactacggagcggcaaacgtcgcagacggtcctatttaagaaatcgggggaaactatggcgttctttttgggctccaagacgtacacgggacgcagcggggcgtacagtccccacttgagagcggctcggtgggagtgcgactctccagctaaaaagtcggggccgggcggcctctggcgcccggccacaagggccgaggaggctgcgaggtaggagagagcggtcattgggaccgtcgcgacgcggtccagtcgcgtcgcgaccttgtatcggacgttgcttccgcagcacagactgatgtcgccggccgcggggttttcgcggcgaaagtgcgtttccagctcacgtaggaccacggggcccagcacgtcccgcgaggttatgaccgtcgtagctagatcggggtggccaggccatcggacggagcattggctgcggggcgagacggtgcacctgacgtagcggacggcttcttccacgaggcgcgggccgttctccgggcgatcttgatcctctagcgtgtccaggaccacgagccttttttctcgtttcaaacagaggcgttgcaggtgttccaggacgcccgcaaaaccgaggtcctgaggggacaggaacatgacgccggccgcggtcagcgccgaaacgtccggcgccgctctccaccggcccgcccaggcggcgctctccggtaggcagaggcggttggcgagtgcggcgagcaggaaagagagtcctccccggttcgggtcgaaccggggtcccccggggggcgagccgggcgccggtacgcaaaacaggtgctcgcctgggttggccgtgtacaggatgacgagagcgacatcttcaggcgaagcctgctgatgccgcatccaagcggtgcgcgctctgagagagacgacggccgtgcggcacaacactccctcggacgcagcagtgtctgggcttctgctgacgtgcgagggagtgctcgccacgcgagcgatctccgccatggcctccggagaacgcgccaacggctgacgccacagagtcggtatttgggcgaagctggtcagctcgtcgactccttcgcctggacaataggcgtcgaggtgcggggggccggcatagccagcaatcggagttccaatggggggcttcctaaaggcggcgccacgatgccgtcgatcgcctaacgacagggaaccgtccataatgcgcgcggggtcgcgccacggaaagcaacgtgggcgcttgggcgggaaaggcccggcgtcgcggcacgcttcagggggggtggggggccttgtgcagctggcgacaggcggaggtccggcgcctgtccgggaccttcccaaacgcggacgcgggttctcgacggcgttgtccgcgccgtcgagaaccgccgcgggagctgattttctcttccttgactcggctgacgtttgggcgcaaagggcccgcacgggctcgggagaacttgcggggccggggtcgtaacaaggctccgcggagcgcgaccggccctcggacgttccggaagaggccgcgtcggcgtccgcgagaaggcgcgccacgcgttgcagccgtcgggccttctcgcgggatcgtaccggttcgcccctcgacccacattcgcgcaggagcacggaagtaatgtccctcgacccagggcatcgccaaggccgagcggggtctttgctaagcaacgggccgatcgcttccgttatcagggccaccgcattagccgcgagagttcgctcctggcgcccccgaggagccgaaccgttcgcgtaggccgcgtacacggcgctcctgagatcaagcaggtctcggagccacgacccgagcagagcccggcatttttcccactgttcgtggccggcgggtcgagggaagggcccgtcctcgcaagacgacagcatttccgcgaccgcgcccggaccgtcgggtccgcgcagaagcgccgccacgaccccctcgcactccagcgcgcaagcgtccaccagctcgttcagcggccgggtagacgcgaaaccgtccccggcagggatgtccggacgcgcgggcgcgaccaatcggtattcggggacgtccagcaggccctcctctagcgcggaattgaaggccgcgacgccccggcgcacgcggtcgtggatcgtggacacgtctattaccgggatgagcccggccgccgtactttgggcagtgacgggtgcccgatttgaaataggcgatgccgaggggcgtcgcatttcggcgctggctgcagacgccataggcgcgtaggctttcctgagggagcggaacatgaactctttctgatctttgcagtacctgcgagtcatagacacgctggcggcgatgtgcggtagcgcccaaagcagatttcgcttcttcatggcgctggctatgtggggtatgcatttgttgaccgtccccgtgacggccgcgcccggcgaactgtgcgagctctgaaacttcgtgacatagatgtgattgagcgctgcgtcggtgggcgagagcttgccgtggtgtgcccagttcagggggttcgccttcacgtctttgttaagcatggcgcttacgagcgcctcgtactgtttggcgcagttccccatttcctccacgtacaccgggaggggaccgggagtagagaggaatctaacggcggcctgctctacttcagggatgccccggagcgcctgtcggtgtccgccgagaggcccgaaccagcaccggccggccggcggggagggaatttgccaccacacctcttggtcgaggtcatccggcggtggcggcgcagcagtttccgaggacggtgatggcgcccgccggccgcggccgcgccgtcctccgcggccgcggccgcggcctctggcagcgcattgaggcgctcctgcctcgcgggtcggcgacctggatgaggtgcgcgaagaaggggcggcagacgactgttccgatgaagagggcgcggacgacgaagaggacgaggaagaggaagcggacgaggaggaggaagatctggagcgacacccgagcgaagggtacgaggccgggggaggccggggtaggggatgggaagcgcgggtcgccggcgtgccaacctcctgttgtaatgcctgttttagaacagcaggtggagctgttgtgtgcgaaccatcggagcccgatcccggctggactctgcggtaacgttcctgcgtaccggtggggctgctaacgaggcccggcctcggagacggcccgttccagtctggaacgggaagggggggaaacatgggcgctccgtcgtccctcgcgccggacggctgacggaggtgtctgaatcggcgtagcgccgcggcggtgacggcggcgcgccaatcaagtatggctttgtacagaggtctgacccgtttttcgatggccggaccgcaggcggggaaccccagttcgaccatagcgacggcgagctgctgcaccatgaatccgtaggcgcgtgcgggacgagagccgtggggcgtcccgccgggttccggatttccgttccgcagcgccaacttcgattccctgacggccgcggaaagcgcgggagggagcgcggtggcgggcggggggggcatttcgaaaggcacctcgaagccgggccgcacgtcggggccgacgatgtagtcgtctggggccagcagtaacccccgacgcactttgaaaaaaagacacctgtaatgtagcatcttgaaatcgttccaggtgagcccggtccaggggttcgggctgccttcccggccttccacccaccgaatctcctcgagcagaggacagaagttggaggcatagaagccgccgcggcgccggctgcagtcgagaccgcggggggattcagagggcggcgttccgttccagtcctcgtccaagggagtacccgcgcccggcggcggcgcgcacgccggaaagcacggcagaccacgagccgcttgtaattgataggaaaagtcgcgtgtcagaacgtgggccatgtactggacgcgcctgacgcagcggagtcggtccagccagcggtatgaaaggcggggaaccttcgacacgaaatcgggggtgacttgaaggccgaggaagcgaaggagcgccgacaaaatgtaagcgtacgtcggggtgcgcggagccggtctcgggagccgtgttaccgcttcccagatgcgcgttggcagcactatcggggcggggagggggagcgggcactcgttctgcgggccccatccgcaaccctgcgattctaacacgctttccccgtcctcggacggcgacatatcgtccagggtcgagagaacgaggcgcgcgcatcgagaaaacaaccacatcttgcaggccgcccagtcattccccagctcgttcggagggcacgggaagaccggctcctggggcagcgggcgacccttcgcgcaacgccattcgaacggccggtagtcgctgtcgagtaaaggggcctctctcggcagttcgatagaccccggtgaggtccgcagagggctgccgcgcggagtaggtaagatttctctgagtaccgcttccctcgccagccgatcccagtaggaagggcaccggcgagcgtccgacaacgcgaggagaaaaaccttagggttgtctccggaggacggctccgtcgcgccgtcgcgagcccccgcgcgccacaacatagcgtggctccccggctggcgggccaccaactcgagctcttctcgagggggggatgggatcctggcggatgcggataggcggcagacgtactggaagcccgcgcccctggtacgggggcccccgccctcggaaacgctcgatttacggcgggctgggactcggtcgctccggaggggagcgggtgcgaggcggggggctgaaggggacaacggaggggaaggacgctgacaagaagcagagagggctggggggtccggggaaagaggcctgtcgtggagaggggttggcggaggtggggtagacgccggaggcgagtcaagcggtagagacgcagacggggaggatgtctgcgtagagggaggggaggtagacggcagaggcgtggggggaggggaaccgtgcggagggggggtatgcggaggtggcgtaggaggaggggggctaaggggaggtggcgtaggaggaggggggctaagggggggtggcgtaggaggaggggggctaaggggaggtggtgtagggggagtgggtgaatggtgttgagcgaacggtcccggcgtcagcggagaaaatgtccatgggaagttcacgataggttcgggggggggtggggggggcacgcccgagggaggggggagagtttcgacacagacggcgagcggcgtgcaggcgccggtgggcttacagggcgcgtcagatacgcagcggacggggtcgtttgatttgcggggatccatagggctcggttcgccccgttccgaacccgcggggactagatcgccgactgtcttttgccaagaacaggaccgcggggccgccgcggccgtttcgtttccacagacgtccacgatgtccgcggtggaactgacgacctcgccaggagacccctgatgcgcgccgtcggggggttcggcggaacggagacccgtatccgaaccctccgaaacggcaccctcaatgccgaaaggggctcgtgcgccggcaaggctgcccgcgacgggagccgcgcgggcaggggatttagaccgtggcgggacgggctgccgaccgggcgtcgggggcacggccacgctcggtgtattcaagcacacgtcctggtacggatctcccggggtggcgggtggctgcggagaaaatccgccgttgtcggctaacatctctaacaggctgtagaaatcgggcgggttctccatgtccgagcaatgggggaaacgcgcgccggtccaaccgtggcgacgccggcagcactggcgatccgctccttacaggggcgtaaatgcaggggttaatcgggcggatggggaccagcgcagggagcgcggaaggagtcctgctctgaaaaaaatgagggggaaccgtgagaaagcgttccccgcagttcgcatcgcttcttgccccccgcccaacaccaccaccaccccgcccctacacacaccacagccacggctccggcagtgccggcctggctactcctttaatcattaactcccatcaacgcgatttgatccccgggctgctctccgaatcagccgagccccataggtaaacattccgccgcccacaacgtttcttgtcaaacaaacgcttatcggccggattgcgaaacgagcaggttttgccattagatatgctgcggtcagcgctgctaggctccccgggggcaaacattctcctagcgacgccgaggtaaggagacattaaccctcgacacgctcctgcgagcgactgtgcggttcgtgcggtttgtttctctcgctcccgacgttcctaccgccctcgggagagtgctcgcccgggggctagaacccgaagcggaccggcccttgagcatcgagacgcttaggctcgggcgaaccgcccggctctaaaaagtcaagcgcgcgcgtgtatttcttttttttgggggggggggggggggtggtggtggtggttggagacagaagaggagagaaacggagggggtggtggtggttggagacagaagaggagagaaacggagggggtggtggtggttggagacagaagaggagagaaacggagggggcggtggtggttggagacagaagaggagagaaatggagggggtggtggtgggagagaaataccgacggccggacagagcgaattattaagcacccaacgctcacgccaacacgtcccacctctttccccgacccgcgccgccccccccccccccgatattcgcgtcgggggtcagggacaaagagaggcgacggggcaataggcgctgcgtgggggagggggggccggccctacttgcccctaacgcaccggcgtccacgcgatcgcgcgacccgacagcacctaccaggagcgcggtgccggcggcagccccttctcgattcggctcggagctagccgggagagacggccgcggtcacgtctccctttccgaacgcctagcgatatagttacagaccgaagcgagccgtgtcacaccaagtcacttagccgcaattctgttccccttcccccacacacataacaggagacatagcgcatgggaggggctttccttatctctcgagcagaggtcgccgacacgtcaacgaagggcggtacgtgtgtggtaagtagcagagatcggagttggtcccgatttactaacatctaataccgatcgttcatagccgcctggaatttgcgggcataacccgcggataacggtactggtcagggaagcaacgcagcgcagacacgacccgatataaaagactgcaaacgaggttttgtaggggtaatgagatgatgtggaaaagaaatgggtcagggggcgctgtttgttgtgacacatttgcgcctagtgtgggaccggggcgtgcggcgagcacccagcgcggaacgactcgcaagctgacggtgcagggctaactcgcattagaggaagtgtttgctgatttcttcgtagacgctctgcgccgagagcgtctcctcgtttaacctttatgaagaaggaagtcgctcccatctggtgcggaacgatggggtacttctctccgtaatggggaaccgaaaactgaaccaaatacagaaattagaagaggaacatcggcttttcccgttatgtaaaaggaccatggggtcgcgtccgggaggagggggagagtttggggaactcggggccctaagagcgctacaccagactcttcataataccatatgtcaaggcagttgcggtaaatatagcgacgaccgcaaccgaacgggtatttcttctacaggttagaaccatcccatgacccatgcgaaaagtgttacggcacagagaaggccagagggaaactccgcgtccggcaaagcgcacggtaagacactcgcgaggttgtgcaacagcgcatcgccccgggtagaaccgacaggtttatcttcagatggctatcgcggacaactcgtcgtcggggctgggggaggggggggtatgtgtcagccacttccatcctcgtcgctgtcgtcgctcgcaaatgtgggctatcaacgcttctcgattaaaaaaagacaaactagaggggcatccgcaataaacgacaatgtttcatcacaaaacaaatggcgtggtctattctttttcgtttgcctctgatcctgggcggtccgtactgcggggtgatagataaaagaagacaacagcagggaatcgaggtggcgagctcacaaattgcgaagctcagcctatgccggcgatgatggccgatgagggaatgtaggaagagagggcgtatccccgattgacgatggtgcgaccaccaaccgagtccgtgtactcctatcttccattctcacgacaccggacatgagaaacgatgcgcggagcaagtcgggggggggggggggaatgaatccacggcacgcgcagcgcttcctttacattgcaccacgtgaccatattcccataatgacggcaggcgttatctatataatgccaggcagaagtcttacttccgctcgcgatcactattgtcgtcacacggggagtctgactaggcggtatggacggcgtacgagacagagtattacctgatacgtcaacggacaacgagatctaccttgggtcggggtatccggtgcaattacatgatgaatatgggcaaatttctctaggctcgccggtcgaaagcagcaatagcacaggaaatttttgtgctccgccatggatgccggatatccctcgtttaagtaatgatacatgtaagatatttcggtgtctgactagctgtcgtctcaattgcgcaccgttccacgatgctctcagaagagccttgctcgatatgcacatgttaggtcgaatgggattccgtctacgacagcacgaatgggaacgtatcatgcagttgactccagatgagagcattaacctgcggagaactctcctggaagccgacgagcggagcagtcattgtatgccgaacgtgtacgcatctgacattagtaattccctcgaagctggtacaatgcaagttacctccagctccaatatccggggtatcagcaacaagtccgtaaatcactgattacaaaactcactgatgtagacgaacaataaatgtcctattgccagtaatcactttgcctgttatttattgaatgagtatgtcgcgttaattaagtaacgcagtgtgggcgtgacttgtaccatatagatttctattgactacaacgttatccgacctgacatttgggagctgggtgtctatagagacagaaggtgcaccaccgcgcaagataatattgtgatatgtccagtgaggtatgtgaagtaccatcaccgcaaaagcaaatgggcctgtggtcggtgtgccgcaaacttcgcagaacatctcatctgtggccggatcctgcgaatgagaaagtatacggtatactttctgctggtggagtacatatatcatccctgccaaagtctgtacgcggtttggcccgaactgtattgaccgctgccatggtctctttcgcggcaatgaaagctggtatgccgccatccattcacctgtggcgtgagataatggatttaactgacgcaacaatccgccgcgaacaacggtccacatcaaatttctacgtagccggttcgttgaggaaaatagtaagtgttgcattgcgaaattataagcatgcacctgaaacgcatggagaaatggatagccgtctgactgctattatgtattggtgttgtcttgggcatcctggctgctgtattgtttcccatttatatgaggaaaacagtgatctgattaagttgttgggaatggcaacaggctgtggagaaagcccgcttactgaagtagagtcttattggaagcctttatgccgggctgtagcagcgaaggggaatgcattaatttacgacgacgtcgaagtggcacattacctgatcaacgtgcgacaatcgtctgaatcttcgcctccagacgatggggaagacattgagtaaatttgcgcgaatgacagggctcggaaacaatgtatagagttttgcaaataaacactttattgacttaccagaagttattgcatcttattgtaatctgcgtcaatattctctaacttcagttaaaacgtagcaatcgcagaggggcaaactagagaaaaatggacccgcgacctaaatctcgtctaaaacgctccagtgctttacagttcgataatctggacctggggacgcgtataggatcgttcctccacatgcgctgctgtcggtatctcgaatccccggtattcagttgaatcgttggcggagtgtcctcctggactctgcaatgttccctagccgtcttcactatctcgtgcaaggctctataatacagttcctctgcagacccgtcgttgctcttcccttctgcgtcgttagttatttctgtaggctccagacgatttgcctgcatttgtgcgcaacataatctgattgcattccctatctcgtcttccggtaatcccataggtgttcggtattcgcagataggtagagaaagcaccactgcaaatcgtgcaatttccattgccccaaccaatattttttttaagaacggcatcgccgttaatgtacctcgggcattgtgacgatcgaaacccttatggatgcctaaagagagcattgcggtccagttctccaggtgaaaagagaatagcgcgggtagaaacgggccgattagttttatcttcgccgcgtccctaatatcccaagttctgcagtataacttccatcgtccgttttcgacaaggtccggcgcgacatagtttgaaatgtcatctatcagaaacatctcgcccatcgtagaaaaaaacctgtacgcagaccataaaaccattcggtaccacatatccttgtgtatatcaaacgatatgttggttatgtcgttggcggatgttgtatgaaatagagctaagcgttctctggattccacgcactgaacgattccgttagtcaattcatctgctaacataggccaaaagtttattcgtgttacttttctcggcggtttggcaaaacgcccccttggcacatccatgtcattaaatacagcggcataactcctactcatgtgttccatagcccaggtttctgttcggtctgctactacgatcagatcagtggcgcgatcagatgcgtgggatgaatgaagtgtatccgaaagcagttttgagatatacgctaaactgtacgacgattgtggcactaaacgaagctttgcgcgacccccatcccacgcggagtctgtgcaaggttaatgaccctcgcagttcattcggaagttataactgccgccttcgcacatttctttttgtcctgttttgtattgccataacagataggaattgaaacctgatcctcctgttttttgcagcatggccagcaacagaatactttgtcggatcgactacttgcgcgagatggttccgttcttggaggtttcggcgggtcgggtggagaacctattattttatacacacacgtcataccgttgtcgcgaaaatgttctttgtcttctgccgtctcgaacgtcggttcccacgtagacgttaggagcgttggaatggtatcaggaagagcccacggcatgccggaccaagtacccgctactttgaccgcgagcagtctcttcggtaatgggatgtattccagagcagcgcggcagagatcagcggcccccactatccacagactgtatgaagtgttttctgaaacatcggactccaacatcaaatatccagacataacatcttgccattcggaagcacatccgccgacatcttcaaatagcctaactataaacgagtctctagttcctgctaacccagtacctcgaatgccagtcccatccggtgggttcgtcctgataatcggtctctgacgccgaggaagaactaaaaggggtctggaaaagcggaacagatctgcagaccgaacgactacagacacgcccacatcatcatgtatctgttccatgcattgctgtgatgcggcactcgatctcggccataatggccgtcgactctagaggatccgaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccccgcggccgctctagatcaagcttacctccttatagcccggattatgtctttgaagccaaatgctcctgcaatcttcaggggagagttgaggtcggccacctccatgaagtactcacgaaaatcagtgtactcccttgttggccagacggtcttgatgccaagacggtccctctcactcagtatcaattttgtgtagttcatggctcctgggtcaaatcggccgtattctgtaaccaggttctttgctagttcaggatttggaatcagctcgaagttactcaccccagcgaccgtaacgacggatcctgttgccactctttcgtaggctactagtgtgacgggacggagggcccctggatagttgccaccatggatcgtcactgctaggctcccacttgccgaccatgacatctgatcccctgcctgaccaccacttttggaggtcactatctccagtttgatggatgtgattggctgggttatctcattggttggaatgacaagattgaatggcataagattgtcggtgccggccgtcagcccattatctgcggctacagctctggtgattaccgcagtcccatcaaagcctataaggtagatggtggcgcccagtacaaggccttggacgcttgtttgaaacacgagctctcccccaatgctgaggcttgtgatagcatcaatgttggctgagaacagtgtgattgttaccccacctggttggtactgtgatgagaattggtaatcatcggctgcagttatggtgtagactctgggcctgtcactgctgtcgcatgtagctaccatttttgggtcaagccctatagcgggaatggggtcaccaagcctcacatacccaagatcatatgatgtgggtaggctgaggacagtgaccccttcccctaccaggacattcccaattttgtcgttgatgttggctgttgcagacatcaacccattgtagctaacatctgtcagttcactcaggcttccttggaaggtcacggcgtttatggtgccgtttagtgcataaacgccaccagggagtgtgcttgacctcactgtgagactccgactcactagtctgcagtagttgtagctggccggtaggttctgggcagtcaggagcatctgatcgaacttgtagttcccattgctctgcagtgtgtagtgagcacccacaattgagccagggaatccagggaaaaagacaattagccctgaccctgtgtcccccacagtcaaattgtaggtcgaggtctctgacctgagagtgtgcttctccagggtgtcgtccggaatggacgccggtccggttgttggcatcagaaggctccgtatgaacggaacaatctgttgggtttgatcttgcaggtttgtcatcgctgctatcgacgagttctagagcggccgcctgcagcgaggagctctgcgttctacggtggtcagaccgaagactgcgacggtaccgacgctggtcgcgcctcttatacccacgtagaacgcagctcagccaatagaatgcgtgccaatatggaatttccaggggaaaaccggggcggtgttacgttttggctgccctttcacttcccattgacgtgtattggctcgagaacggtactttcccattaatcagctatgggaaagtaccgtttaaaggtcacgttgcattagtttcaatagcccattgacgtcaatggtgggaaagtacatggcgttttaattaaattggctggaaaaacccaatgactcacccctattgaccttatgtacgtgccaataatgggaaaaacccattgactcaccccctattgaccttttgtactgggcaaaacccaatggaaagtccctattgactcagtgtacttggctccaatgggactttcctgttgattcacccctattgaccttatgtactgggcaaaacccattggaaagtccctaatgactcagtatacgtgccagtaatgggaaaaacccattggcttacctcccattgaccttatgtactgggcaaaacccattggaaagtccctattgactcaatgtacttggctccaatgggactttcctgttgactcaccccctattgaccttatgtactgggcaaaacccaatggaaagtccctattgagtcagtgtacttggctccaatgggtttttcccattgactcatcccctattgaccttatgtactgggcaaaacccaatggaaagtccctattgacgcagtgtacttggctccaatgggactttcctgttgattcaccccctattgaccttatgtactgggcagaatacaatggaaagtccctattgactcacccacattgaccttatatgcttgccaacaatggaaaaacccattggaaagtccctattgagtcagtgtacttggcagcaatgggtttttcccattggctcacctcccattgacccaatgtacttgggcaaaacccagtggaaagtcccatttgactcagtgtgcttgccagtaatgggaaaaacccattggcttacctcccattgacccaatgtacttgggtaaaggccattgagtcaccacccctatgctgggaaatggtgaacgccccctatgtggaaagtccctatgggccgccattagagtgcatgaccgtgttgattcatatgccatatgagtgtattagggggctttccgcttgggaaattgggtaaaaagtccccgtattactcacatagggggcgtttggctttgcaaattaggggatttcagtgcatttggcattaaaaactattggttctagtcataaaacgggcggagttgggggatccggcctaggcggccataacttcgtatagcatacattatacgaagttatttaattaaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttggtaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaatctagagggcccttcgaaggtaagcctatccctaaccctctcctcggtctcgattctacgcgtaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacttaattaaataacttcgtatagcatacattatacgaagttatccggtgatgcggcactcgatctcttatgagaaaaatccataaggccgaggcggcatctctagatctcccggggagtctctcgcactcatctaggagagtgacgacagttatcatagacacgcccatttgtgcaccaaacgaaaagttcctgtactggtggagcgtcggcgcgggaatcggtccgtgctctgaaaccagtgtctagacagaagaccatccggtaaattctggtgtatgaactgacggtctccagacgaacgtcgaagacattaacgatggaaactaacgagctttcttcaaaagtgtctgattacaacgctaatagaccttacgaaactatacgcagcgataccagtgacacagatccgtcggtgtcgtgtgggactctctccgacaaagacggggacgacgaagaatctatagatttaagcaaggtcccgaatgcaacgaatgtcggcgcaggtgaagattgcacatcccccaacgacgggcgcacagagttatgccgtacgacttcggttaccggaccggcctcggtcgtgaggatgcaatacaatattatttcaccattaccgcccagctcggagggccgcgtattcgtctgtacccgttgggacgatgtcagcaataagaaggtgattgttaaagtcgtcaccggaggtagagacccagggagagaaatcgagatcgtaaagacactttcccattgcgcgattatacagctaattcatgcatatagttggaaatctacggtatgtatggtaatgcctaagtataaatgcgatctgtttacctatgtggatagaaaggaatcaatacctttgaaagacgttattgtcattgaacgacgtttgttggaagctctggtttatctgcacggcaaaggtgtaattcatcgcgatgtaaagacagaaaacatatttctggactaccccggaaacgctgttttgggagatttcggggcagcgtgcaaattagacatgcatgataatagtcccaagtgctatggttgggccggaactatggaaacaaattccccagagctcctcgcgctagatccttattgtgccaaaacagatatctggagtgccgggcttgtgttattcgagatgtctgccaaaaaaaggacactgtttggaaaacaagtaaaaacctccagttctcaactgagagcattgattagatgtttgcagatccacgctttagaatttccacaggatgaatccacgactctatgcaaacaattcaaacaatatgcaatcccactgcggcctcctttctccattccagaagttgtaagaagaaatatcccgtcaatggatgttgagtatacaattgcaaaaatgctcacatttgatcaagagtttagaccttcggctcaagacatcctggcgttccccctctttgtgaaagaagccccccaaaatctccaggccctatttgttccctgagtgctaacagcacatgcaatcgaatcccattagaagccgtgctatttaaattttaatgtcgcatagaaatatatggtatacggcgccacgcagagctctatacggcttccactttagaagccaatgttttgtcatcagtgagtaatacgacttgggttacaagagacaaacataatacgtcgaacttaacaaatgccggaatctgtacccgttttctcatcgccgctgctgcatattaacggcaggaagcccttaggtatagcctgagcgtttttacgtccactgcattgccatattcgctacatcacgtatttctacaagaagatgagagtgtctattcaacgggcaattttcctgatatacatatgtacagtctccatgtccagctcggaaaaaactcgtaatgaggacgcctctcgtattagttcttcggacacctttcgcctaaaagaattccccgtatctgcgataccatcgcctctactcgacgtagtcgataactcgtacccgacgaaacacgtcatatacactgacacttgcggtttcgctgttttgaatcccaccggcgatccgaaatacacaatcctcagcttacttttgatgggacgacatagatacgatgctactgttgcatggtacgtcctgggtaagacatgtgctagaccaatttatctacgcgtattttcagattgtcatacaaatgaacaatttgggatgtgcacttcaaaatctccgggatggtgggatattggttatgcaaaaactgcgtatattgaccgtgatgagttgacgttagtattagctgctcctgctccagagttgggtgggctatacacacgtttaatcataattaatggcgagccaatatctagtgacatacttctaacgattgaggggacgtgtagtttttcgctcaaaggcccaatcgacgaccggctctgtaaaccattcaacttttttgtaaatgggaccacgcttgacataggcatgtttcctgcacgaactccccgaccccatgaagaaaacgtaaaacagtggcttacgcgccaaagcggaaaactggatacggttattggtgaagcgtccatgcgtcatgcagcagatttgccacgtgcttttagagattcgtatttgaaatcgcctaaagataacctacctgacgaccctggaaggcctacagtttcaattagcagtatccatgccaatgatgcctatgtaggaagcacctctctgtatgaccaatcgctacgcgcaactgaagagccagtattgccatctgtagatgaggcccgtcctgcgctttatacaaatgcagagaggaaccccaggatgcaactaataatttctgccattgttgttgctagtactgtaatggtcgcactgattgggataagtgcatgtattgttaggaaatgctgtaaaaggaaaatcaaaagagggatacctcaacgcccgtccaggaaagtgtattcccgcctatgattacgtatggacttgggcgtgtcgacacagacacaaaacccagtttgcggccttcttgaaactatcgatgtaatgtctctgtcgaacgggcacatggcacattggagtgcggcgtccaaaaaacatatactatgtttcctatttcttgtcacggggagccattctctaatcttcaccgggacttcgttatccgcatcgacggatcaatcggccatcgttgccttctgtggactcgacaaaacggtgaatgtttacggtagacttttcttcttgggtgactcggttggtgttatttcttacgatggaacgacagaaattctgagatggaacgaaaaactaaagtgtttctcggtcatgtatgccgcgttgtatacggactgcccccttgcagggtctgctttatttagaggatgtagaagcgcggtggtgtatgctacccctcatgacagggtgaagccggtttccgaaaaaggattactgctgtgcatttcagatcccagaatttctgacaccggtacatattacatccgcgtgtccctcgccggcagaaatgtcagtgatattttcagaattgacgtcgttgtgacgagtagcagtattcatacatgcggccatgcggataaaggtatacaggaatgtattaggtatgccgaccgtgtgtcattcgagaactatctaattggacacgtgggacaattgctgcctgtcgactcagagctacacgccgtgtataatgtcactcccagatcggtcgttgggacaaatactgataccatgtcagcttttactaattcgacaacaaaatctgcttcgacgaatttaatcgctatgaagactactcatccaccaagtacgcggcgctgtaacttgaggcgtgcccttccaaaattaatatacatgtcttcattggcaggcctgtgccttctcgtactattaattggtagagcggttgtaaagtgcaaaacgcccaaacccaaaatctacaagggcgactccacctctgacggcatctcgcttatcaattctgcagtaaacgacgcatttgggtgtaatcctgcaaaagaggttgatccctcgaatatttctgaaggcgagaagctggaaaacatgcagaaaacgaccggaaatgtagaaaagtaaccgtgcgagttatgagctggaatggacgttacatgcgggaagaagtagggcgtaactaagtacatgttagaaggggaggggcgggttttgacttttaaaagcacaccgcgggaccacggcggaattatgcttgatatacccgggctacgtggcataatgtcttgtccgcgaatgccccttttcctaatggcggcgatgatgtgcagtgcaaccaccgtaaatcgtatactaattccccaggggaattcggcaacacttaagatctccagatatccgccggttgtagatgggactccatatacagagacgtggacatggatctctaatcgctgcaacgaaacggcgactggatacgtatgtttggacagcgttaattgttttcatgacttaatcgttaaaatggcctgttggcggtattccaaagaggtaatactgcgcactgccagattcgtggtagagaggggcgtgttaaaaacgatagagaccgctaagctgcgcaacgctccgcgtgtattgattgtggacaacgtggacactcaatggactgttttgaatgcgagcgagcaaaacgcgggcatttatattcgatattcccgaaatggaacgagaaccgctcacgtagatgccatagtccttgccgtttctggtcgaaagagaggcagggtgccaccgacagtttatcctgttggaccatttttgcacaaattccaaatctcccttaaaaattttaaaacgttcttatatcaggtgggggataccgttacaatatcgataactacacgcctggagacgacggttcgtgcgttcaagttggagtttcgggtaatgtttctcccctacagtccaaactgtaagtcgttcactatttacgagccgtgtattttccaccccaaagagccagagtgcatatctccgtcggagctatcggaatgtcggtttgcatcaaacgcgcaggtcctggaaattgccgccgcacgctcggtgaactgcagcgcgggccgcgcgtgccattacgatgccgaggtcgacgaatcgatgcagcaaaggttcgcattcctttattcggaaatcccctcgtttacaattggcaatgccgggccgggggacgcgggtctgtacgtcgtcgtcgctctgtgcgatgagcggccgacaacttggactcacgtctatctatcgaccttggacaagatcctagatgtgcacgagatcgctcacaagccgggatttgatgacagagtcttatcgagcaatgacgacgccgctcgcggtgtaagacccggagcggccatcgagaaagaatcaggtaggctccgtctaagcggagccctaattgcatcgatcgtgctggtggccgcggccgtcgtaactacggtaagcttttgcggagcttgcgtcttccggtggcgtcgcaggtgccaccggaagacgcaagctcccggcaactcttgcaagtacatgtcgttgccccaaaatcattgggaagagttttacgacgacgttagggttggcagcgcccctcagtatgagcagtttaaccaaaggttgcccgagagaacgagatcaggctacaccgcttggctctcgtctgatatagccgccgtaagaaagcgtctcgattgaaatcgccgagacgtgcgtgccgattgttgtttttattgtatcgcccgtacttaacggtcctttatccccgcgcgaaataaaactgtccgactcagtctactggtgctcgcgtttacctccactgcgtaccgcgcgccaattttcgtgtaggtgtgcgtatggtggagtggtttgggggaccctgtctctaagccggcacactccacgctatttccccccgcccggtgggcacaagcgcttgcgggaggaaccagttgtcggttttttatgcgggctcctcagcaccttcgccacccacccacactccgcgccccgactgcgcgaagctgccccgtttaggcaaacggggcccggccggcgcgacgcagaagaataaagcagactccgtcgtttcttctataatggagggtatactcgtttattgcgacatcacaccccgtgttgctattttaaattgaaggccgttgataacccgcatcatccactaacgtcgttagcgataacgattgtatcttcccccccccccccacctacggtttgtcgacagctatgataagcggaggaaaacctgcctgattccttgggcggggatccttgtgcgctgtcttgctctgtatgcgccgacccaaagccgcctcctcctcaacgtaaatttaaccgcccaggccgcgtagttgcgtgtcctgaacgggaaagaagttcgttcgctgttattgtggtcattaccgtaactgtcccggcgtgcctccatctgctgagtcccgtgcagactggcatgaggatggttgttcggcggcaggcaactcccccctcatccctactaatcccgaatgcctttaatgatcacgcaataacccctcctcttaacaatatctctttttcgatgaagatttcagttcccccataacacggcagaacgagtctgatccctgatcaattggaacgacttccttcttcagaaaggttaaacgaggacacagtctgcgacgagagggcttaacacttcctcctgtgcgagagcgcgtctctgcgatgtggcttcgccgcaaagtcctttcccatactaggcgtaaaccgcactataacaactccccctccccccagcacccaaggggcccgtgaaaccgcgactggtttcttcttcactggctcagtactgcaaatgtgctgcttacctcgtgattgctgtcgtcggggctcgttcgcactttccaggccaccaaagaaagcgagaccagagccaatcgggaccatctccgaaccttgttcgctaccacacacgtgccgccctttgttgacgtggccgcaaacagagctcgtggccacgccaacgaactgctcgtcctataaaacccctcccatactcaatgccccctgaaatgtttgcaggggggaaagtgaagccttctgcttcattcaggtgttcgcaatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacaggaaagggagacgtgaccgcggccgtctctcccggctagctccgagccgaatcgagaaggggctgccgccggcaccgcgctcctggtaggtgctgtcgggtcgcgcgatcgcgtggacgccggtgcgttaggggcaagtagggccggccccccctcccccacgcagcgcctattgccccgtcgcctctctttgtccctgaccccgacgcgaatatcggggggggggggggcggcgcgggtcggggaaagaggtgggacgtgttggcgtgagcgttgggtgcttaataattcgctctgtccggccgtcggtatttctctcccaccaccaccccctccatttctctcctcttctgtctccaaccaccaccgccccctccgtttctctcctcttctgtctccaaccaccaccaccccctccgtttctctcctcttctgtctccaaccaccaccaccccctccgtttctctcctcttctgtctccaaccaccaccaccacccccccccccccccccaaaaaaaagaaatacacgcgcgcgcttgactttttagagccgggcggttcgcccgagcctaagcgtctcgatgctcaagggccggtccgcttcgggttctagcccccgggcgagcactctcccgagggcggtaggaacgtcgggagcgagagaaacaaaccgcacgaaccgcacagtcgctcgcaggagcgtgtcgagggttaatgtctccttacctcggcgtcgctaggagaatgtttgcccccggggagcctagcagcgctgaccgcagcatatctaatggcaaaacctgctcgtttcgcaatccggccgataagcgtttgtttgacaagaaacgttgtgggcggcggaatgtttacctatggggctcggctgattcggagagcagcccggggatcaaatcgcgttgatgggagttaatgattaaaggagtagccaggccggcactgccggagccgtggctgtggtgtgtgtaggggcggggtggtggtggtgttgggcggggggcaagaagcgatgcgaactgcggggaacgctttctcacggttccccctcatttttttcagagcaggactccttccgcgctccctgcgctggtccccatccgcccgattaacccctgcatttacgcccctgtaaggagcggatcgccagtgctgccggcgtcgccacggttggaccggcgcgcgtttcccccattgctcggacatggagaacccgcccgatttctacagcctgttagagatgttagccgacaacggcggattttctccgcagccacccgccaccccgggagatccgtaccaggacgtgtgcttgaatacaccgagcgtggccgtgcccccgacgcccggtcggcagcccgtcccgccacggtctaaatcccctgcccgcgcggctcccgtcgcgggcagccttgccggcgcacgagcccctttcggcattgagggtgccgtttcggagggttcggatacgggtctccgttccgccgaaccccccgacggcgcgcatcaggggtctcctggcgaggtcgtcagttccaccgcggacatcgtggacgtctgtggaaacgaaacggccgcggcggccccgcggtcctgttcttggcaaaagacagtcggcgatctagtccccgcgggttcggaacggggcgaaccgagccctatggatccccgcaaatcaaacgaccccgtccgctgcgtatctgacgcgccctgtaagcccaccggcgcctgcacgccgctcgccgtctgtgtcgaaactctcccccctccctcgggcgtgccccccccacccccccccgaacctatcgtgaacttcccatggacattttctccgctgacgccgggaccgttcgctcaacaccattcacccactccccctacaccacctccccttagcccccctcctcctacgccacccccccttagcccccctcctcctacgccacctccccttagcccccctcctcctacgccacctccgcataccccccctccgcacggttcccctccccccacgcctctgccgtctacctcccctccctctacgcagacatcctccccgtctgcgtctctaccgcttgactcgcctccggcgtctaccccacctccgccaacccctctccacgacaggcctctttccccggaccccccagccctctctgcttcttgtcagcgtccttcccctccgttgtccccttcagccccccgcctcgcacccgctcccctccggagcgaccgagtcccagcccgccgtaaatcgagcgtttccgagggcgggggcccccgtaccaggggcgcgggcttccagtacgtctgccgcctatccgcatccgccaggatcccatccccccctcgagaagagctcgagttggtggcccgccagccggggagccacgctatgttgtggcgcgcgggggctcgcgacggcgcgacggagccgtcctccggagacaaccctaaggtttttctcctcgcgttgtcggacgctcgccggtgcccttcctactgggatcggctggcgagggaagcggtactcagagaaatcttacctactccgcgcggcagccctctgcggacctcaccggggtctatcgaactgccgagagaggcccctttactcgacagcgactaccggccgttcgaatggcgttgcgcgaagggtcgcccgctgccccaggagccggtcttcccgtgccctccgaacgagctggggaatgactgggcggcctgcaagatgtggttgttttctcgatgcgcgcgcctcgttctctcgaccctggacgatatgtcgccgtccgaggacggggaaagcgtgttagaatcgcagggttgcggatggggcccgcagaacgagtgcccgctccccctccccgccccgatagtgctgccaacgcgcatctgggaagcggtaacacggctcccgagaccggctccgcgcaccccgacgtacgcttacattttgtcggcgctccttcgcttcctcggccttcaagtcacccccgatttcgtgtcgaaggttccccgcctttcataccgctggctggaccgactccgctgcgtcaggcgcgtccagtacatggcccacgttctgacacgcgacttttcctatcaattacaagcggctcgtggtctgccgtgctttccggcgtgcgcgccgccgccgggcgcgggtactcccttggacgaggactggaacggaacgccgccctctgaatccccccgcggtctcgactgcagccggcgccgcggcggcttctatgcctccaacttctgtcctctgctcgaggagattcggtgggtggaaggccgggaaggcagcccgaacccctggaccgggctcacctggaacgatttcaagatgctacattacaggtgtctttttttcaaagtgcgtcgggggttactgctggccccagacgactacatcgtcggccccgacgtgcggcccggcttcgaggtgcctttcgaaatgccccccccgcccgccaccgcgctccctcccgcgctttccgcggccgtcagggaatcgaagttggcgctgcggaacggaaatccggaacccggcgggacgccccacggctctcgtcccgcacgcgcctacggattcatggtgcagcagctcgccgtcgctatggtcgaactggggttccccgcctgcggtccggccatcgaaaaacgggtcagacctctgtacaaagccatacttgattggcgcgccgccgtcaccgccgcggcgctacgccgattcagacacctccgtcagccgtccggcgcgagggacgacggagcgcccatgtttcccccccttcccgttccagactggaacgggccgtctccgaggccgggcctcgttagcagccccaccggtacgcaggaacgttaccgcagagtccagccgggatcgggctccgatggttcgcacacaacagctccacctgctgttctaaaacaggcattacaacaggaggttggcacgccggcgacccgcgcttcccatcccctaccccggcctcccccggcctcgtacccttcgctcgggtgtcgctccagatcttcctcctcctcgtccgcttcctcttcctcgtcctcttcgtcgtccgcgccctcttcatcggaacagtcgtctgccgccccttcttcgcgcacctcatccaggtcgccgacccgcgaggcaggagcgcctcaatgcgctgccagaggccgcggccgcggccgcggaggacggcgcggccgcggccggcgggcgccatcaccgtcctcggaaactgctgcgccgccaccgccggatgacctcgaccaagaggtgtggtggcaaattccctccccgccggccggccggtgctggttcgggcctctcggcggacaccgacaggcgctccggggcatccctgaagtagagcaggccgccgttagattcctctctactcccggtcccctcccggtgtacgtggaggaaatggggaactgcgccaaacagtacgaggcgctcgtaagcgccatgcttaacaaagacgtgaaggcgaaccccctgaactgggcacaccacggcaagctctcgcccaccgacgcagcgctcaatcacatctatgtcacgaagtttcagagctcgcacagttcgccgggcgcggccgtcacggggacggtcaacaaatgcataccccacatagccagcgccatgaagaagcgaaatctgctttgggcgctaccgcacatcgccgccagcgtgtctatgactcgcaggtactgcaaagatcagaaagagttcatgttccgctccctcaggaaagcctacgcgcctatggcgtctgcagccagcgccgaaatgcgacgcccctcggcatcgcctatttcaaatcgggcacccgtcactgcccaaagtacggcggccgggctcatcccggtaatagacgtgtccacgatccacgaccgcgtgcgccggggcgtcgcggccttcaattccgcgctagaggagggcctgctggacgtccccgaataccgattggtcgcgcccgcgcgtccggacatccctgccggggacggtttcgcgtctacccggccgctgaacgagctggtggacgcttgcgcgctggagtgcgagggggtcgtggcggcgcttctgcgcggacccgacggtccgggcgcggtcgcggaaatgctgtcgtcttgcgaggacgggcccttccctcgacccgccggccacgaacagtgggaaaaatgccgggctctgctcgggtcgtggctccgagacctgcttgatctcaggagcgccgtgtacgcggcctacgcgaacggttcggctcctcgggggcgccaggagcgaactctcgcggctaatgcggtggccctgataacggaagcgatcggcccgttgcttagcaaagaccccgctcggccttggcgatgccctgggtcgagggacattacttccgtgctcctgcgcgaatgtgggtcgaggggcgaaccggtacgatcccgcgagaaggcccgacggctgcaacgcgtggcgcgccttctcgcggacgccgacgcggcctcttccggaacgtccgagggccggtcgcgctccgcggagccttgttacgaccccggccccgcaagttctcccgagcccgtgcgggccctttgcgcccaaacgtcagccgagtcaaggaagagaaaatcagctcccgcggcggttctcgacggcgcggacaacgccgtcgagaacccgcgtccgcgtttgggaaggtcccggacaggcgccggacctccgcctgtcgccagctgcacaaggccccccaccccccctgaagcgtgccgcgacgccgggcctttcccgcccaagcgcccacgttgctttccgtggcgcgaccccgcgcgcattatggacggttccctgtcgttaggcgatcgacggcatcgtggcgccgcctttaggaagccccccattggaactccgattgctggctatgccggccccccgcacctcgacgcctattgtccaggcgaaggagtcgacgagctgaccagcttcgcccaaataccgactctgtggcgtcagccgttggcgcgttctccggaggccatggcggagatcgctcgcgtggcgagcactccctcgcacgtcagcagaagcccagacactgctgcgtccgagggagtgttgtgccgcacggccgtcgtctctctcagagcgcgcaccgcttggatgcggcatcagcaggcttcgcctgaagatgtcgctctcgtcatcctgtacacggccaacccaggcgagcacctgttttgcgtaccggcgcccggctcgccccccgggggaccccggttcgacccgaaccggggaggactctctttcctgctcgccgcactcgccaaccgcctctgcctaccggagagcgccgcctgggcgggccggtggagagcggcgccggacgtttcggcgctgaccgcggccggcgtcatgttcctgtcccctcaggacctcggttttgcgggcgtcctggaacacctgcaacgcctctgtttgaaacgagaaaaaaggctcgtggtcctggacacgctagaggatcaagatcgcccggagaacggcccgcgcctcgtggaagaagccgtccgctacgtcaggtgcaccgtctcgccccgcagccaatgctccgtccgatggcctggccaccccgatctagctacgacggtcataacctcgcgggacgtgctgggccccgtggtcctacgtgagctggaaacgcactttcgccgcgaaaaccccgcggccggcgacatcagtctgtgctgcggaagcaacgtccgatacaaggtcgcgacgcgactggaccgcgtcgcgacggtcccaatgaccgctctctcctacctcgcagcctcctcggcccttgtggccgggcgccagaggccgcccggccccgactttttagctggagagtcgcactcccaccgagccgctctcaagtggggactgtacgccccgctgcgtcccgtgtacgtcttggagcccaaaaagaacgccatagtttcccccgatttcttaaataggaccgtctgcgacgtttgccgctccgtagtcctcccccccgatccgcacgcccagccagtcgtcgttcacgttcccgaagcgacgtgcagtttattggcccgcgagatgctcgctcacctacgtagctcgtctgtagtgtggctggaaggggacggcggtccgccggagaccaccgtccaggaggaacagggcgcgcgacagaggataattcatcctccgacgctgcccggtcctccttcgcccttggccctcagcgactctgaagtcttcggcgagtgaaggctaagtcagggtcgggggggggggggcggggggagtcactcggcggacttttaagggctatctggacaagcagccccgcgggtacgacatatcatccgcgagcggggagacggacaaataaattagggggccagcggaaccccgcggctcggttgcgttccgcgctgttagtcgtacgggccgcggtctgccgtgcggatgcgtcaccgcctggtccattggtcggccgtggccacgcctctatacctgttcccagaacgaatgccccgcgcgcaccttcgcccggccattcagtagcgcagaagcgccggcgagcccgcgggcgcgttcgccgtagtgttctcccgcaaacgcggtagagaaagtttcgtaaaaggaagaccgcgcggcgacagcgcctagaagacccgtggcctgtacgaggaggagcggcggcgaaagcggggtcctttcgccctgcgctccgccaaaggggggaggggacggacaatggagcctcccacggcaaagtcggacggggccgcaccggatcccgacggcgacgtgaaccgaaccgacccgccgctcattgtccctcaagcctcagaactccgccctaccttctccgaaagctcccgggggtccccgacggcggtctgcccgggaaccgaaaccgcgggcgcggagccgtggccccctggactcagatcgccgcgtcctttccgaaggcctgcgcggctgtaccgaagaatcgcgatccctagggctgcggaaaccgctcctccggatcctgcaacgagctccgctccgtgaaggtcatctcgaacggatagaaccgctcaaggtcgggggggggggggggggtggtggtagggttaacggtagctgggattgagatgtagcgctggcgaataaataaataaataaatgaatgaatgaatgaatgaatgaatgaatgaatgaatgaagggaccagatgcgacagacatcattcgcgctctctgaccgactcttgccggcggcggcagggggtttcggtcgccctgggtggccgggggggggggggcggggggtgcgtccggaggcagcggcgcgcggggacacctctgttcttacgctgttcgcggagagccctctaccccgcggatcgatccctcgcgcgggagcaatctctgcggtcccctgcgcagcccgcggagcggttcggtccgcggcgcgctcgcccgctcgcccgcccggctatcctcttccgcagcggcaccagaaagtggcgggaacgagcgcgcatacgggagacataaaaatggcgggggagacgggtttctgatcgagtcggcgagcgggcccgaggaaagcggcagcgggacagggtttccggatcggaccgcggcggctaccgaggcccgctgtcgcactccgcggtccctaattgttcgcccgcgcacccccctcccccaccccattcgcgtcggcgagcgggcccgaagaaagcgcaggggggacacggtttccggatcggaccgcggcggctaccgagtccacctcgcgccccccgcggaccccaatcgttcgcccgtgacggtctctggactgttctgcccctccccctttcccccaccacccacgccgcagacctttttcgagacgaaccgcggctgtcctaagtgaccgagacgggcgcctgaaaaagccttgcgtctgatcggggggggggggggggcgcgactccaagcgttagaccgccgaccgccggcggctccgcgcggccagtaggccgagccgcacgctgcatccccgccggacatgcccgccggccgcgcgggcgctcgctaggccgcccggaaatgcgtagcggacccgtgcgcgcatgcgcgcagtcgacatttgcgagcatgcgcgcggcggaccctagcgagcatgcgcgcggcggaccgtagggagcatgcgcgcggcggaccgtagggagcatgcgcgcggcggaccctggccaccaccaaacgtcataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggct

SEQ ID NO: 36 - DNA, 169094 bp, unidentified
  source 1..169094: mol_type = other DNA; note = Secuencia del genoma completo del virus rSB1-VP2
ataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggctgggccgcagcctcccgccgccacaggtgcactcagcccgcgggctgccgcaccccgcgaactgtcggctacaggcagaatgaacgcgcagcattgcgcggacacagtgggtgaccgaagcacaccaccacagactctgaccctgccatagccccgaccgtgaaatgaggcccggcgaggcctaacagtcaccccgaccgtgatacatgacaccaacgctgcccgttacattaaaaggtcctagccctacatgccgtaaccgccaaagccgctacccttaatatgtcctgaccccgactatggactattaccctaaccctgaaaggccataacagtgaccctaacagtcctgacgccgaccccgagaggccctaaccgccaccgtaaacggccctggcccaagcccttaatgtggccctaacaggcactaaaacgaataagacaggccctaaccccgaccgtgatgacaggccgaacccccgaccctaacagaccctatcgcggggtccaataatccgctttcccaccccgtccttcaacggaagagtgcgtgcttcagacccgcggacccgggcaacttgtacccggccccgagcgtctctgtgcaacgcactacattgaaagtaaacaacaggtaggcggtgtcgactcaggtctgtgcgaacgccaaccgctttcaagaacggaggctacgcgcagtcacgaatgaggaagtggttttgtgaggccgatcccctttcctgtttttttgagactcgcagccgattccgagaggaccgggagcgcacgacgatgggctcccgccttacagttttctccgcgaacaccgtactcctgctgggaaggtaagccgcggtccactgtttacttcccgtgcaagcacttccgcgtacgcgattgtccggcacgtccggacgcgcttaatttccgtgtcctgactgcatccggcgactacagcgccgcatccccccctcaaccccccccccgtagattccatggccgagtccgccacaccggctttttggaatttcgcggggggctggcggagaccgcctctgtcccggcgctcgggaagtgcgtacaggatgtttttctttttccggcagcggtgcagcaatggcggggacgcaggacgcttgggaaccgcggaccgcagcctttgcgtcgccgccgggagacggcggcttcatcgcgcacgcgggcgctcctagccccgacccgggctgaagccgtcggccagtacgaataaaaacgcccatggaatgctgctacgagacgcgtccgtccgtccgtccgtctggctcgcgcgcgagcgcatgcgcgcacatccgccgtttccgtaaacaccggaacgacaccctcgccggccccgaccctcaatccgcggcacgccctgaccctataaccattacacgccccgccctaattccgagagaccttaacccctaacctaaccctgttaccctacccctaacaggccctaaccctgacggggagggggaacgcctccttaacagactaacaataatggggggggggaggagggtcgctcctagccctaacgggcccaaccttcgcgcctaccctacccctgccaggccctaaccctactcgggggggggaggggggatgggaacctaagcgtggcaggtcgaaccgtgtggggggggccctgcccgtaacagaccccagcccctacccttacgggccccaacccttacaagaccctaaccttagtactcggtgggagcctaacccgaatagggcctgacattaataggccctaataacccttacacctgtgaccacgaactctgataggccataaccctgaccttgacaggtcctaaccccgggcccctaagccaaacgccgcccttgagaccctaaccccgaggccttaaccctgacccagagaacctaacactgataggccttcgcgctcttagtctctgatcataatcaccccgaccctaaagacccgatccagaagcctaaccccgaccctaaagacccgatccagaagcctaaccccgaccctgaccctaaccctgcccctaaaggcctaaccccgaccctgcacctgagcttgcccctaaaggcctaaccccgaccccgacactacccctaaaggcctaaccccgacaacgacactacccctacaggcctaaccccgacaacgacactacccctaaaggcctaaccctaaacccgacactacccctaaaggtctaaccccgaactcgacccgacccctaaacgcctaaccacgaccccgagactgcccctaaaggcctaaccctaaaccagacacaacccctaaaggcctaaccccgaacccgacccgacccctaaacgcctaactttggaccccaaccctaaccttaacggcatatccctgtccatgaccctgacacccgaccctggcactaacccttaccccgagcccctgcccctaagggcccaaccatcaccctaaaggcccgaccctgcccctaaagacctaagcatgaccttaaaggcctaaccctgaccatgaccctaagggcccgaccctaaccctaacctagtaccctccttccacaccccccccccgaaaaccgagcatagcccaacaatgaactcggccggtttaaagatttatttcgatgcgatgcgcggtcacgcccaccacaaaaatagaccctgcaatattgatgccggaaccagcccatcgcagagcgggcgaccgctacacgggacgcgtattcgtcgggaccgcctttctccggcaggtagcctacacgtacctcactatggccataaagatgcagccatagagaggtacgtgaagaagacccgtcggaatcagaagcaacatttcaggacgtacgactcgagccggacatgataccagacaccggagtccacagcgaccgcgatttcctctgcgcctaccctcggccgacgaacaacgccgagggtaggcgtcgagaaaatcgcgaccgagggtgcgccctcgttccacgcgatcccgcagaacgcttcgcgcccagtctccgtccatcgacgtggtgcttgatgacaggatccacctctaacaccacgcgatgcgctccgcagcgccttcgtcccggagtagagcgccatctccttcctccagcacggtgctcgacgcggcaatacaaaagtctcacgcctcgaacaccggacgaaggagggaactgcgcgcgtctggactttaccggggcggcttcgtcccgcggcgttccggatgacgtttcgagggcccactccatccttcggtgcggtgcccgagaagggatgacgacctctcacacacagcacaaaggacggcgctgggctccgtccgatgctctcgatctcaggcagcacggcaccgatccggagagcgcgtcgcacgtcgcgtcctacccccggagtagtgcatgacggttactccccggcaagcactcgtccgaaggaggacacgccacgcgacccgattcccagccgcttcgcgcccggctacttcttcgcctgcagtccgccggcagggctcgagcaaacaaactcccatctttccctgacggcatctaaccgttaaaatacgacgtcaggcaccgtaagggaaaaaatggaagcagttcggagtacagacgcctaaccacgggccctctctcgcccctccgcgtccgatatgcagatcggtgagagtactgatcgtctcatatccgcaacgaagacttcgggatcgatagacgttatccttcccgcccccccccccccacataggaacctctgttccatcgccatctgttacaaaaaagggcgagcctatccactggcaacgagcgagaacacagctaggcctcccaggtcgtaacaagccacttacgtcgtcgcgggggaaggtcggtccatttcgctcctattccgcaccttcgtttggaacagaagcattacacacaccgccatttccccgcgggcagaattctagtctttttgtggttatgctcccacctacccgcacagacacgtactcacctctcacgatccagcatatcgccgtaagatttacagacattcctccctccccacccaaccgaacactgcacagcggcagcctaaaagtcgctctgcggtcgcatatcccccccaccccccttcgatggtccggtgtacggagacctctcacacaacacaggacaccgtaccacggaccatccgaacggcgggcgaacagtcacgcaggacgtggacacgagtcctgcgctcgcacaggcagctgggcggcggtgctgtcttcctccgacggacagcctacaagcaagccactaggactaccgatacgaccagagtgacgtgcgtgtaagacggcccaggacgaagtcccgcgccccgccgaaaataacagcaccgacctgaaagagaccacgtcttacccaacagccgacccccgaacgatgcacgctcccaagagtcggccgtaggagagcacgcgcccccccatactcggcgcgcgtacccgcggccatccctgcagcgcggcccggcctcgttgcgattcagtgaacgtaccgcgcgccatctccgtccatcggcgtggtgctcgatcccgtcattcggtgatctcaagcaccccgcgaaggaggaagcggagcgtgtaacgatttccgcggcgcgcgacgacgccgcgccgtcccgtccgacgtttggaacgccgcctcggtccttgcgcgcagtacttgagacgatacgtgttaaaatctcaggcaccacgctaaggacggagcagagctcggttcgcttcgctcgcgcgccgacgcatctctgcttcgcagaacctgttttgaaaagaccgcagcgaccaccgcgtgctaccctcggaggggggcatgaggacggcgcccgatactcccgtgcacaccgccgaggggggacacggcgcgcgcgccgatgctcagccggttcttcgcccagagccctcccaaccttgtcccacacgacggggagcggcacggggaatcaattcgtctttctctccgcaggcattgcacaacggcaatgacacgtgcaatgccagcctgagagaaaacatacgaacagtcccgagttccgagtagtaactctcgctttcgcgcccttccccgactcgttccgagcatatcaggcgatacgaggcatttcgcgcgcgtcgccctgtccgtcccggttgtcctagaacgtgacacctctaggggacccgggaaggactggacgacgcgccgtcgtgcggtccgaccgcaatacggcgtcgttaccccttcctcacaacacctgatctcgtggcctaaatacccgctcatcgccccgcatccgacgcctctacctcccctttgtccccaaccgagaaacctatccggggcccgctaaggtcgaaccgccgagactccgtcgtccggctattacccgccataacaagtcgctagtcgaaggatggaatcgcagcggtccgagcggctctcctctgatatcccggcacggcctattgggattaaggtccgggcctattcagattacggttagagtcctcgagaaacatttcagtctctctggcatctgacaacggctacgcgccactcagatgccaaaacagactggatgcgtttccaaaggccatcgtgtctaacaaaggccagtccctgtaactaggccaaacatctcatcaccgtccaagtcacaggtacttcaggtttacggtcgtctgctatctacaacgaagaattcagagccgatctcgccagggccccttctcccccctcccttcttcccccctcccttctccccccctcccttctcccccctcccttcttcccccctcccttcttcccccctcccttcttcccccctcccttcttcccccctcccttcttcccccctcccttcttcccccctcccttcttcccccctcccttcttcccccctcccttcttcctcccttccccccccctcccctcttcctcccttccccctcccttccccccctcccttccccccctcccttccccccctcccttccccccctcccttccccccctcccttccccccttcccccttcccctcttctcccccccccctccccactccctcccttcttcccccttctcccacctccgttcagccttccccctcccccctcccttctcccccctccgttcagccttccccctcccccctcccttctcccccctccgttcagacttcctcctccccaatcgccccccttcgcaacttgcgaaatctagtctaacacgggtttacttacgcggtttacattcacacagcgggtgcatgttttccgctgacatttcccaagccggccacaagaaacgaagcaaaaaaaaaaaagataggggtattaatgcgcgccacccgtcgctacgcagcccgactccaaatttcgaataatgcccttctaggcattggaccgccgccccactccccgcgcaatatctaggcttaatcgccaagattgaccacgtatcccttatcgcgccggccgttcaggccctccccccccccccacgcctctcgactcttttttttttccatgggccgtccagactgagacgacacgtagattcgcggtcgtcccagaataaaggatgaccccgcgatgcccattcccactcgcccgacgtctccctccgattcaaaagtactgcggcacgacctgcgatggaagggaaaaacacaccaaacggccttaagttttccggtttgcctttcccttccatcgcaaatagcccgcaaaagaaggatcgcatttccggccccgtccggccatcgcgactcatccaccggccaaacggggatatcggaccgcgagactttaacggctatgtatttccccacccgctcttctcagaggaatccccgatgcaatctagaagcttatcgttcagagcgtttcgggcacggaacttcctgagaatatagatcatctctcagggtgcaccgtaccacacaacgtttctgtgggaaaacggaaggccagtcactttcacgtagacccctcaggatacccataacagaaaaactcagccccccctcccctcacgaccattttcctacgtggaatgcactacaagtacctgacattttgcaaacagggcgccgagacgtccgatggggttccagcttccgtggcggacgaaccaacaccagtgtgggcgttcgcatctccccccccctcccccccccccatacatgaaagacctacgattactgcataggaccccgctcctgggacaaatactccggaaacctccagggatcggaaatttatttagaaggggggtggggtacagggcatgcttgcttaggatctgctcgaaacttgactataaaaggcaatctgactagaatcgccaaaggcgataggtctcagaagaaaagtaggacgcgcgggggagggataattgtttacgcgggggggaagataaatggcccacggcggaaacgagaaagcgcgggggggggttaggccttggaagggggaaagacgcattcgcgcatgtcagaattaagatggcttccctataagacgaacgcacggtttaacagaaaagcggacatcacgccggggtcgaacgcgggaaaataaaaccgttgcgggggggggggggagtccgaaccgtgcggcgggaaggctccgagtccgaccggaaacggaaaaaggcggcacggcacggggcgctcaacgcacaggggataggaagaatttcccctcggcccgcggattcggatcgcgctcgcgatccaccttttctccgccgactcgccgaccgcccggaacgccggtacttacgcgctggagaagccccgtattactcttcttcccggattcggccccggcgcttctgcgtctgcgcggcggacatacgcagttgcgcttccgtcgacgtattcaatgtaaacaaggaagtcggccctgcgacttccgcgatcgcgatcgcgaaccggtaaacaacgcagggggagcgcggagcgcgggcgcgggcagggagttaacctcgcgatccgaccgcgcattcggatgtgcgggtcgggggcgtagagataacgcggcgtttccgctccgggccggagaggctggcgggcgggtctctccgtacattctttttttttgcaaacgcgccgctgcgcgcctaaacgccgcagcggcgcgaaacgcccgcgctctctaagcgtccgaaggccgtacggacaccggtgcgtccgggcgctcggccgggcgaacggcggagcttttctttctcttttcagtctcggagaaaacggcccggtgcacacctcctctcgggagcgtcgcaggaaagtaagttcgtgtcactcaccacccccccccccccgccatcgacacggagtctgagcatgagggctttaataaaccgatttgaacgtgctacgacgagagtccgtgcaagtgttcgcgctcgcgcctatacgtactacgacagccgctctgtagccgcggtgtgtgtgggggtgtgtgggggtgtgtgtgggggtgtgtgtgggtgtgcgcgcggccgggacgggattcctgattccgtagcacttcatctcgaatgtggaattcggttccgacgggggccgttaacacatatacgcgacactggtcggaactcgcgacttccacggtcgccgcgtaagtcagtggtgcttatacgtgggaacgaagcgaggctaagtagcaggtcgcgaacaaggaggtggaccgcggggctgtttatatcgcatctgcgtctcccgcggggccggtgagctaacggctcctccccgtcgcgaaactgtatcccccgcacaaacacctggacgatccgcgagcgacttatgatgcgcgtgcccctcccccaactaacccttcgcgcgcaccgcgggcctcggcgcggtacgttctccacaacactaatcgcacgcattcccggtcgcccgtcgccccccccctcgcacatcccgcctcgggggagaggagaggacaaagtacgttccccgacttacgcgacggactcccccgcccgcgccatcgccagacaccgaaacgggaccgaagcgagaaagactttttaataaacacgttcatacgcactacgacgagaccgctcgcacgcggtctcgtacacgcacgtacaccttaacgatcgacgcactgtacgcgagggctaagagcgggcgagcgatccaccccgtttcgcaagaaacgacgcgtcccgggcgcggctccgctaagcattcgtttacacggcagtttcggcgtctccctcctccggtcgtccgtaggagccctctgcgtttccccgcacggccctcgaaaccaaactccacagactcttccagacgtttgcgacgctaggctggcccggggcgcggacgcggtctgagggcttgagccggtggctgcagctcgtgagagcgtgttcgaactctgaaacgtaaaacggtccggctcgattccggataacgcaaacgtcttttcccctcccccccgatccggcaggcgagaccttcccactcaacctcggtcccgcacgggcttgggggggggggggggagggaaatagccggccgaaccctactcgggcccggacccaaacgacatcgctccaaaagagagcgttccgtttgacggagcccgcggtgcgtacctgcacgggattccggatcccgatcccatagcgaccaatctcgaatactgaactccgttgttccgtcggaggccgttaacacatataggggcaattggtctgggctcacgattttcattgtcgccgcaaaagtgagtgtgcttgtgtgtgcaacaaagcgagaccctctaccctgttcgtgaggagagggtcgcggggttgcatatatgtggcatatgcgttgatcacgggaccggtgagctgacaactcctccccgtcagggaactctattccccgcattaccacatggacgggccgcggcgtcgcggcgtttcccacacccctccaccgaccatgccccacccccgctctcgttcgagaggccgtcccctcccccatttcgttccgcctcgtccagagccagcgcgggacttcactttttccccatccctctactcctatctcgttgcccagcccacgatcgctatgtacgcgttctctccgaggccggctcgcgccgagccggccagacaaagtcacttcggaactgacgccgaagtgagtgctgaacggttgagggggcggcgtatcgcggataagctattctcctcggagtctttttgcggcaggccgcaagcttcctcgtacccccctttcggggttcgctagaactcgatcgaaacccgagacgagttactactgagccgatccctacagctcgggaccgctcccgaacagaacgcggcctcatcgggttctttcgtagagcgccgcaagggcagaaacggaccgacgcgcgtccgagactcatcccgagctcacgccgaacggctttattgctccgcttccgaacgagagagcggtcctatctcgaccggcccgttttcaatcgattcccgaggttccgacctcgccgcgggtgcggggccggggggaaagtcggggggcgacccgcgaccgtgttccgcgagcggcgttcggccgcgtcgccgacgcggggtcggatctcgttctcgtgcgagggatcgggacgatccgcggacgagaacgatggggcgtcctccctcgacgtccgacggttccggacgccgcgagggtcgcggcccgaaggcggagatgccgagctcggccagttcgatgccctcggtacccatcccccttccacccgtcggcgacccccgcgaacgcgagccgtagacgacgttctcgggacggcgcgcgatcgcttcccggccgcctgcgatcccaacgggacgggttcgttcgccgcgcggttcgcccggcggtaaaagaacgaccagaaaatccgatccgcgacggcgggcgctttattaccgcggtcccgcgctttcggacggcgggccggccagcggaacgacggtccccgccggacctccgctcgcgtatttgtaggccggaggtccccgaatccgcccccgtgggaggggggcggcgtttctagcccccggcgcgggccgcggccggacacgaacacgtggcataggatcccgcttcccgattggcccggacgggcgttcgcaccttgcgccaataatatattatatatataatcttatattggttcgcggtgcgaacgctgacgcgttcgccccgctcgtttgcattgcatcacgtgatcgttacgccctcacgaccggcccggtcataagaagcggaggcgccggatctccgcttagagcgccggtccggcgcttcccgcgaacggacgcaaggtggcggcagaggataagcgatcgccgaacgagagccccgtcgggagcgatcccggatcggacgccgcggcgaacgcgtaggtttcggccgtctcccccttcccttcccccacacatcctcccgccccccacaacctcctccccggcggcctcggacggcgcctcccccgctcttcccgaactgcaggccggccggctaccctccctcccccctctcctccttccccccctcccccttcttctcccgtccgaccggcccggcggaacgcgatgcggcgggggaaaaggcgccgatccgacggacgcgatcgcgacccgaccgctgatccgcgcgcccctccggacgccgagagggatgcggagcgcgagagcggagccggggacggagggggcgacccggacgccggagagaacgacgccggagggcgcggaccgggcgcggacccgggcgacgacccgggcgacgacccgggcgacgacccgggcgacgacccgggcgcggacgcgggcgcggacgcggacgaggcgcacgcgcgcctgctccggcgcgccgagcgcgaaaacaagaaactccgaaggggatgtaatttagtgtttactataagcaacaaaaccctagtagtcggaacatgttttatgcttgcggcaggtgtactagtcggtgcaagtggtgctgaccacgagactgcatgcaacaaaactaatttgctgttggtatttgttactgccctcttgacacgatttatttgaaacggtaacgaatgctcgtgtactttataattgcatgcccgattacaatctgttctgtaagaatagttatacgtagcgtgttttacatagtcttcgatgtatagaagagacgcagtcaacttgccggtgccgtgaaattgtctccacactatgatgtttttactgttacaaggtaattaaagaccttcgagtttttcactccacttgtgtgacgctccttcgattatgagagtacaatgtcgtctaagggggatgtggatcaccacgcgggttatggggtggcactcgcaattattgctctattgctcgtacatgctactgcactgattatggtgagtgtctttttacctctgtcccatcagtaattgctaaacaatgattgttttaatgccaaaaatctttttttagatcttttctgatgtcaaattcagaccagtttcacaggatcttagtacgcagtacccatctcataagcattatgatgatgcgtactcgccacatatgtctggggtagaccacggccattcggatgtatggactaacactgtaaatgacccatccggcggaataaactcaaatttgcctggtgcgaagagcgtggagaagatctatcctagcgtagaaccaagtacgtcgcatgacaaagtgtcgtatggaaatgcatggggaggggacataaacaccggcagtgtttcaccttctgatgacaaagcattgcccgccactgtcgaaccatcgacggacatcgtttccatcgcgatcacggggagcagtttaaacggagaaagtagttggcggatttctaaggatggcccgcgtcgggtttatacaccacaccagactaaaagaagtcctcctcagatcgatggcacgcgtttatctactagaacggcatacttgagtgtgtgggatgaacaggaggggatttttaaaacgttcccggccaatgctgctgcattcaatttattggacgctaatcagttagagaaagcgcgccgtgaagtttttttcgttgtgtcggtgtggcatggaaatacgaacgaaacccgtatatttttatccgccacgaggctactgacgcgaatgatgtccacatcgctcgtcgtttatctttcctgggactctcgaggggccctggggacgacaactgatgcggcttttctggcacggagcgtaaatatatcccagttcctgaccgctgtaccaccacattcgcaagttcgttgtatgggccattcattaggaatgtatacttgcggttccatctgtagacaatataatagtgtaggtacgaccagatgcaaaagcattttaagtattgatccttacggcgcctcatcacccgagtctcatgtatcctcggcagacagctcaaatacaatacgctttgatgccgactatgttgcgattttcgcaacaagtaagtggcacttgaacacgtccgattcaaacgcagacgaatatataatagtagatggcttgaatgcaaatgctgtgtgtgtcgatccctacgagtggagtgtcttattgtgtgttagcaatcgccaacgaaatgccgtttgtgagcgattcggtgctaacaacgtaacgactaccggcgaccctgcggaagacggttcggaaacatgcatgcgaatactccctatactatcggtgctgcagtcgctcgataagaattctgcgtatccgctgttacgtatggatccgccgggagcttctgcagcggtaccatccttaccgtccacatggaatatctacgtgatgggaaaggattacagatattctacttatggaaaaaatgagagcctgtggtattctagcgccgtgcatatgggaggaccgggattctttcctgcgtcggtatttactgtgtttcttccctcgggtatacccgctgtggtatccaatgtcgtgcaacacagtagcatcagttacggagatgtagcggttcattccgctttcttaactgataggtccctctactacccccgagtgatggtccaaacatccgggcctattttatctgcctattcttggagagcgcgactgcataatgacagcctctatttattaccacttccagaacaggagataatgcaatacaaatgcgcagttgcacagggaagctatgcatgtagtcccacaggcccgatcttgacaactgttatgtggcgttcactgttattcgcgggcagatcttcgccggtgcccccaaacggtagttgtttgacttatatccccgctaacacaatcatccggagccggtcccccattgaaataggccctcgaagtattataactgcatcgtttcagctaagcagacaattaatggctatgacgctcgaaaatcatttcacgtccacgaaccggactctattgacatttcatgatgtgtgccacgacactgctatggagtcggatatatacttcgagtataactggttaggcgcatcgatgaacattaccatactgaaccccggcctctatacgtttagatggtttttcccatttgaggttttcgtaatgccggtggtagttacgcctcccaagtccagagcggataccgtcacgatcgctcccgtaggactataaccctgttggacaaataaagtatacagactgttcaaactgtgtagtgagtccatcttagtcgtactggatgcaaacgagcccaataaagtgtaacagttgggaaaactttaactgtcgtgggataacccttataatgttatagtgcagtgactgacttgtaagcaaacattgactggaagttagcttatactgtacttcgtcgagactgccgttgccgactgtacgatggagcggcctctcgatcgtgactatcaaagtgcgataacgtgcttgacgtgcgagagagtacttttttgtcgcctctgacatgggcaggttcgtggcgataactccaactacatcaatgccaagaggtttaagcgttaggtcgccggtttaaatactcattcggaagccgtgggtggcgcctcgcgtaccccagaccgttgtgttataaaacccagactcgtcgccacacatgtaggcaaaaaaatgactagcgaaagagctcttgcgctagcacccggtcgggcggccacggcagatttctacgaagtggatccggtatatcggcgagacttcgcacgccggcttttacaacgtaagttccagcttgtcgtgttgtagaggtatttactactctgatcttcacctaattagcaccatgccgtttgtatttaggtttattccccaagacgcttgccgccgtcagggaatcggagggaggccgaaacacgcgcccgcccaaaacagatctgtgtacgcttttgcgcataatcgcgcatcatgagaccccgcacattttcaccccaggtcccagactcccgaaatcctcagcaattgtcgacgggctatgggtagcgtgtcgaggacttgcggcagagtgcatgttcgatggccgggcgacaatagagttagcagaacgcctcgcaacttcatggttgacggccataagattaattctagtttggcatcccgtgtatgccctcggccagcaacacgaaccactcgagcggatatgtcgccaaggtcgagaatatattgctatgctctcgggaacgattcaaacatcgtatgcgacatggccgttttggcaaatgatgcaacgatgcttagattggtgctgctcatttcacatccccgatgaccgttcttgtgagcacggatctccacgtctggggatccaactagagggcgaaaaccagatattcgcgccaagtttggggctctactccgctgtaatggcatggaccccaattccatgtcacgtacaggttcctgtatttccgagacctggcgaatcggacgatgtctcgaccccgcctagtggggcacagataggacgggtgcgacctcacagtcttcaaaggctggcactaaaacacagacctattgatgccgatgtacatagacccatgccgttaggccggccactcccttcaatgcatatggacgatccagacgatccgcaacctggaccctccggacaaggccgggcgcccagaactccaactctggaaggagtccgggtcgcagaacaaccggtaagtcttcgccgcgcaagaacaccaccgccgccgctcaatgtcgacgaagacgacaacgatcttcctcccggccaacccccccgccctcatcttcgaactcccccatcatcaccatcgtcctccgagactgaaatcgatgaggaacttaacgcgcaacccgatccttggggtacaaaccgtagctctacccctacagataactcctctgccagtgaggatgaagccagagggagcgggttgccccgaccattgcgcagcgcgactactgaaccgcgcgtaacgcgtagaagccgccgtgaggctcgcagccggagccgaagtcggtctggagaccggaggtggggaccgtcccgattaaggtcaatgcctggacgcaggagagcttctcgacaagatacagtacttgtagacagttctgaagaggaaccgtagccgtttgtagtcagggttctagttaagtaggcgccgcgcgatttacgaattagtacatttgggccctgccgcgcagcgagcgtctcacgactgcgatagtcatgcacgtttcgctggtatgggtgctgtgtttgcttttcggaactagtgggggtgttttaaagtggtctgacgttgacttgtcgcggggattcatttcggtcccaaatgtaagttcgcttatgcttttagactgcgctccaaattcgatactctcaactgccagattcgccgatctgacaacagatgatgtccctaccggtatatttattaagatcaattgcagcgttccggaattcattttatggtatgggtctaaaagcgtggcggcgcggctcaacccaattattgcaagcgctttaatgatggacgatgttttaaagagcggattggacgattccgtgaaggcggaacttcgcgtgtttttaaaaagaatatccgaacggctaccttggagctctctccggaaaagacacggttgtctgaacctggacgcaccttatgacttctcctgttatggctcggcacggctcgacagatttgaacgagacatcgaggacgatggccgcggaatgtcatgccgagctaaatcaacccgagctaaagcggcccgcaccaacgccatcgagggatagttcggccgcgattaaaaagcgtcgccggccgatcggacctccgcccggtttcgcgccactgggcgataatgcgccatccccacagggtgaaactgacgcgtacggacatcaactgtcgatgaccgaaaacgtccgcgctgaattgtggcctgttatagccgagtcttacaacatagactggagttggaaagattggctgctccccgaattatgctgtcctaacggctccaagttgttggcggaatacgaacgccgtgctgcggtagaagacgtctttcctccgcgagcagatattttcgcgtggactaagtactgcgctccgcccgacgtcaaagttgtgatcgtcgggcaagacccgtacgttcatccgggacaagctcacggcttggcatttagcgtcaagcgcggcattacaattcctcctagtctgcagaatatattttcggcagtcaaggcgtgctatccctcgatcgaactcggagcccacggatgtctagaagactgggctaaacgcggagtcctgttactaaattccgttttgacagtaaagaagggggagcccggatctcatcactctctaggatggcaaactctggtgcgaaacgtgcttcgaagactgtcgttgtcgactcgaggcatagtcttcatgttatggggagcgcgggcacagactatatattttcaaacggatcgcgacgatcgacatttggtgctgaaatacagtcacccgtctcctttatcccggagaccgtttgcgtcctgcacgcactttaaagacgccaacgagttcctctgtaaaagcggtaaagggggcatagactggagcattggcgcgtaagtgacggaagggttaatcatcacatgcgtacaaaagtcgcagcgctctaggacttgtcgctttctgcgcgcgcaatgaacgataccgcaccttctgttttggcagtattatccaactggggttggaagagcacacccttgggcaccgtaggccccgtcccgattcgcgacgagactgagtgcgcgcgcgaagaccttccggcacatgattgcgaccactggtgtaaaaccgccaatgcagaaaacggacctatggcaccctccccggggaatcgagattttgcgggaaaccaagaatacacacatttcgacactctgtttatggtctcgtctctcgacgaattgggaagacgtcaactgacagatactatacggagagatctaaggcattctctggccaagtttacaatagcttgtactaaaacctcctcgttttcttcctcgcacgccacgaaaaaggttcgcgcgaaaatgtttcaaagagggcgtcagagcaacaagagcttgcagatgtttattttatgccgcagggcacacgctaaacatatccgggcccaactgcaagcggtaattcaagctcgaaaaccccgcaagtattacacccgcgccgtggacggaactacgcatccggtggtgcccgtctttgtatacgagtttgccgccatagacgttgtcagtttgcatcgagacaacgtgatagaggtagacactcccggctcgtgagcttctcgccgctcatcatgttcgtcgtttcggcagctttagcatccgcatcagactacgccgcgtttttgcgggacaacaagcaagctgctcgcaagctgcagtttccgttgtccccgatgccgagccaacggatcccgcatctgtctaaggatggcaggactgcagtcgcccgggaaacggggtcgagcgaggttatgtcagcgagcggacagaacgcgtcgacccgaccggtcgacgctcgtttcgccaacctagacaccgagaaatgacaagaagcatctaaaacgcgcttgattgtcgagtggctgaataaaatctttattgatcgactcgctttcctatttctgatttaataaccatagatggggcggggaatctataaaataggcaaggtccgcgcggattcgagcacatcgaccgcgtccgcgacacagcatgcaagtggcgacgaacggtcctcaggcatgcacgactggtctatctgtatatctgcctcgcggatcgcttccgtgagaaggtcttcctcgtacccggttgagaaagcgtccactttcgagggtccgtacccgtgcacagcgccaatttcgtgcgcttcgatgcacttactaatctcgggcgcgttttcgggcagagatcttatcggatcgcagctctgtcgatgcgcatctttattagggtctgcgatcgcttggcaatacaatcgcgcgctggattcgtgaccgacccgcattgcattggctgtttgtgtcaaagagccgggcttaccgtagatggtgatcgttatgtacagtgacgttcccatccacataacggttaaaattcctccggaactgctgtataagtaggcatccggccccgtcacggtacacgtagcaaatggtatgacgcacagggattcgggcagaaaggagagcggcgcggcatggtattcggcgccgcactcgccgacgcgtagaagataagagcaaatgtccgcgccgctgtcgacaatgatcagggtacctaccggtcctcgctgtatgataaagttcgacgatgggatatgatcgcatctggtcatcttaccaacggcaatcgagcgcgtaccgcctgcacatgagcaaaccatctgctcataaggaggcattgtccacgcgggctgagcagtgacgttctcaagcgtatacgcgatgaacgtggaccccatcatatccacgtctcatgtgacggccctatgcttcatggccctagttagtatacaatgtggactttcggatcccggagggcggctaataagtgcgcgctgatattgttatcatccctagtatgcgtttcccgaagtgggttaatgttcatcctcagaaacttagaggaggtcactcgagacatggccacgtagacgctgctgagtttgatgcccgattgggcaaaacatatagcaaccctctcaaggctaagcccttgcgatctggcgatagtcatcgccagtttggagcttattccgtagtcggcggttacggccatccggagttcctgatcgtctaccgtttcgacaaaatcattgacgttggtgttaattgctgccatgaaaccgtgttgatctttcaaaaccagggtcggcatgtgaagttccccgagcgcttccgcgacctggggatgtatcttacgtctaataggctcgtctgcaaatgtgttaattctagcgtatgtgtaacccatgagagtgtagctgtccgtctgcaaagcgagcgatagcattcctccgcgcatgctatttataaatatttcgcaccctttaaagctcacgttgtcgacataactatcgaatctggacgctgcaaacttttgcccgaatagctccgtcaggatagaatacctgcccataaacatgctcttaagcatgctgaactgggtatatatctccgcagaagtttctgcgcgtccaaattcgtaattgcaataaagcatgtctatcatctggtcgtcgaaatccataaatagggcatcgtctgtatcctccacatgactgatttggtcattagctatacaatctaattccttctcactgccatagcggtgtcctggaatcgcgaacgactccctctgctccgctctatccggaggttgccgtcccggatagagcagcgcagaggtaagcatcgccaatctatcgtacgcgcttttaacagaattgtctggaagaccctgccgttgcagatagttgtagaactgtatcatgccgttgaaaagcagttgagataagaaacggtacacgtattctacagacccatctccgtgcgtctttatgaaggaatcgtctttcaatacggatagaaatgtctcgaacgtcccgcaaaagccgaaaacccacttccgaagtcgggtagtaacagccacttggctgtttaagacataggcaatatctacacacgataccgcgagcccctgttggctgcgaatttcacatttggcctgtgtggcatcttggtcgcgactttgcgaccagttgctcaagcgtcccgcattggcagcaagccatttttccaacgtaacgtgcggttggttggcagcagtacgatatcgttcgaaactatccaaactgacgaaggtataagccggcagggtaaacactacaaatttcgtatttccggacgttttcaggtagtcgtgtaatctgctcatgtacgcgctgacttctttatgggacgaatacagacgcgtccatcccggaaggttcgcgggattgttgatgtatgcttctgggacgacgaaactatctacgatccgagcgtgctcctcggttatgggaagaccatactctaaggtcttgaggaggtccccgaactcgggttcggtgcaccgtttgttattaatgaatatcgcccagttcttggacagttctaagtacgagcgcaacgtctggttgcatataatatacgtaagaatattttcgctcgtacgcacattacacttcagcttgctatgctcaaatgtggactccaaagaattcgtttgcgtgggcgacccgacgcatatcaataccggcctccttcttctacagtactgcggcgtgcggtaaacggcgtttgtgagccaccaactgtatacgatagccgtaagcaaatactttcccagaagtccagcctcgtctatgacgattatgttactgcgagtgaacgagggcatcgaaccatgtatgccgaagattgtccacgccatactaccgcgaggcttgcttagcagatcctctaacgcgcgaatcatttcaaaccgccctggcccgacctcgttagacaccgccttcaaggcgcattttgtaatgtcggataaaacgtcccaataatacactatatcctttttctgcaattctttcatcgtcggtgggctggtcggacatacgtactgatattttcccaaattcgcttgaatgtgattacctttaaacccgaattcctgaaatatcgtgtttatgtgctgcgatgtgtatgaattgctaagcttgcaataaatattctgcgctgcgacctttgtcgtgccggtgataatacagtccaagatttcggatagcatctgtatgcacgtgctttttcctgagcccgcatttccgcttattaagtaaacggcgaaaggtagctcgcggagttctagatccaacgggctttctagttttgacgcgttcataaaatacgatagcggggggactatatcatcgctcaccgatgcgtccgccaggctccttacacgcgcaatgatagtctgtatcccgtgcatcgcagtgaaatttagatacgttgcctcactgaagaaatcgttctcccgcgacatcgtcggtcttggggaagacgggagtgacgaatctacgtatcttttagggtcggggctggcgtgttgtttatttccgatggagagctcagacgttcgggccgcacgcagtcccgccctaaaacaaattcgacggccgcagttgcaatctgtcacgcgccaatggaaactttcaagcgacggcgattcgcaacagtccctggaacaggactggataataattcaccctactcgccaaacacgtatgttcaaagaggtcctcaccgggcaattgggatatacagatggacagggcatatataactcggtacgatctacagaagccgcgattcggcagattcaaagtaccattctcaccctttctttagatgcggtcagatatgacgacttgaaagaggattggtcgaagcatatggataggcgtgggatgtcggccaaggaaatcgcaaaaaagtatggcgttcatagtgaagccgaagctgttagaatggcaaagggggtgttttcaacttggcgtaaaactcttcaaatgaccttaatagaattggttcggcacgcaacagattgcttcgccgcggccgagaaaaccacgtcctgcttctctaaatacatagactggatctgctgtttaggtatcgttccggtcgtcagaagcgagcgctctatgcaggcgtcgcggccggatagcaactgcagagatcgcgctaccattcgcccgaattgggtattcagcgatgccaccgctaagctactagttgcggatagcgttatggcccgcgcacaacaaatcgcggattacttaactgcatccatgcaagcactgactgtgatagaatacgatagggcccagatagaatataatttcttaaaacgtgaacttcgcgttaaggacgtgttgagcggcgaacgtggcgagtgtatcgttatttggagaccggtaatgaacgacggaggggtaatttttgattcgcccatgcagagaatctacaaggagatgattgaatgtcacgatttgcggatgcatgcggcgctgtgtcggctagtaaacacggcccctataaaggtcctcatcgggaaacgcgatgaggatagtaaaagcatggccggggctcaaagagcaatcgataaagttctgggagaccaaactgaaacggcggcgagctctgccgcctctaggttggtcaagcttataattggcctcaaaggtatgcgtcatgtcggcgatatcacagatagagtgcgggattacttggaggaaaccggcggacatttattggatgcctcgcccgtggatacatctcagcctggcttcgggcgcgctaatcgaccacagagttctacgatatccgatggaacttgctccaataccgctagactacgtgatgcgttccacgcgtccgtcgtgacgagtataaacgaaatgttagagggctatataaataaacttttccataccgtggaagggttaaaggcggccaataaagacttatctgcaaaattaagctctaaagaaatagagctcgacagaatacgcacggaagccctgatctcagaacgggcgcgagctgacgcctcgtgcgatcctcactgcaatccaaccatggaaactttggtgcgcgagctaaaacatgacgtaattgacgtaaccaatgcaatggaggatgagtcctatatcgcgaatagcttccagtctcaatacataccatcatacgatggcgatttgaaacggctctctaacatttgggaacaggaaatgttgaggtgctttaagatgactcgtatcaccagtaatcaaggtcgagaggtttcgatctcctactcaaatagcgctataactttattactcgccccctatttcttctccgtgttgcagatctatgatattggtgcgatggtcacgagccaagacgtttacaagtcggaggaggagttatgtaattccgtgcttgaaaaaacccgactttgtacatatctggatgatttggctctcgtctttgaggccgatgtgaaaagagctgtcgcgaagtattcgctccgtgcgggtaacgccgaaatagacttagcgcccgaggagttttcgtacggctctcatggaagcaaatgcgagacacggttttcatccgctagacacgagcgacacgttggacgctctagttttaagcacgctaaatggagaagtcggccaaaacgagaccgtagaagaactaatttggcaaccgacggcgcggatgatgatggagatccgagagattcaaggcggtcctactcaattcacgggcgtctccgtgagtaaacttcgcgtggcaagatgtgatacgcgctttcatctgactttaaccggagccgacttggatgatgaaatggcaagtgacgtataccacagtcagtgcatagttaattcggcgttcaaaggtttcgtctttatggttctcacggttacggaagatatagtgcggacgataggggttccaccccctctgctaaaatacaggctcgtgttctataacccatctgaacatttggacttcgcattatgtttgctcgtagcctatttggagaatctccatgcaagcgcctgcgacgtaacttttttcgtacaggttcaatcttttctgagatacgcatggacacgggtgacgccaatgaccaaaatgcgcagatttttatgcgccacgaacgtttggttactaaacactttgatgtcgatggggtcctgtagcccattcgacggagatcgagtactcccccattatgcgatatacagacatttgtgttctaccagtggcgtctgcgacgtgttactaaccttgtttgaacccgatacacggcaggtacgtgaccgcacgcacggcaagggacttgtcatgctcaacagaggaattatgaataaggcttttcggcagacatggattagtgatacggtctacgattggtggaccggcgaacgcgagaagttgatcggagaagaatctctgttcaacacgtataatatatgaataaagtatgacaggcactgctataaatagaccgtggtttcttagcgttttcatttatttattgcggacgaacagaaacctgtacggctctacgtcgaatgtgaatttgctgagatcgacgttaggccatttcgatgttagagcaccgatcagtaatctcgaaaaaatggacattattggtttcatatgatcgatgcacgcgatggcagggagaattacttgtcccccttcgaaaagtgaacacgtgagaggtgctatgctgccgtccacagtcacggtgtggacggcgtcgttactgaaggcgctcgtatcgaatctagctgccgcccgtagtcccaaagccgtgatatagtgagtgtggtcgcgcgattctgcgggacagctccaaaagcaggcgtctccgcgggcttcgaaagccgcggtcacgagctcttcgaacactgcacgcgatcgttcttggattgtccgtagggactcgtcggaatcgttgcatgcggaaatttcttctaaaagggcagacaaggctttcttaacttggcccgcaaacgcaggtcgggccggaaaccccacgaaatctgtttcccgcttagtttcgttccacagccagtaacaattggcattccacgatactgcatgagtgtataccccttccattcgaaactctaatctgatatcttcgggaaaccgtagcccgactgacgtggctaatttgttagcgctcttaccgcaagcgactcgtagtgtttctaaagcggtttctgttcctttagaggaatgcagaacgttgttggccccgtccgtgaatgtcccccacagtccatctttgacgtaggtacacggggcgaatccgagagccgacgcggtagcttctacctcgagactaatatgattcccgatacagataatagctctataaacatcttcacgcactcttttcaataggcctccgaactctatgatgggctgcttcaaccagtttttctcgcgctgcagtcgagcttttaccgcggcgcgcaaccgggaatgatcgggaaacagtcctagatatagagtcgcaaaaaaggcgctaaaatcaaactttgcgatatacgcttgctctatgaaagtcggttcccggaaaatacaagttatccgcccagccgtccagtcgtcggctacctgacgccgcgtactgcttgtgcgcccttttaaattttcgagtacgtctataccaggggtcggatgggtttccggatgccaaggagcaagcaggtggaaggttctcggtccggccagtggccacaggccatcggtctccgaatagctgccgacggcctttctgatggccgagggggccgccgtagatgttttcaagagcggccaaaggggaaatccgatagtgcaggcatagtcaacgtcctcgccgcgcggactggtttcggggccaatatatacaaatataggggccagccttttttccgagtcatcggctagagagtatatttttttgtgccactgcgcatagatggccaataatgccgtgagagaaaattcggcgggtgtcgtaaccaagcagtcaaaagacgtcggaaccggagccgcggtttttatgggtgcctgtgagtcgggtaatgatagaacgcgttcgacgatagtgaatattctattcgtatttccccatttgattttcttggacctgcgacccactgttttatattcgcggatgaaccggtcttcctttgtgtaaatttcgatacgggagtcgaattccgggatcgtgtcgtcgtgtttaagagccgacaatttaatgtgggctaggtgcgcgccctcagtatactccatagccgtggatacgaggcgtgattcttctacgtgcacggcaccgtccgtttttagtagccccggacggggagcacatcgatcgcccggcagaggttcgcacgatataactaatcccgttgttgtgtctacgtacatatcgacgggtgcgaagtatgcatgataaccgagcttaattctcaattttgccagcgtcacggcgagcagcgctttccatagagcgtgctggtccggcctgcaagacggccaaactcccgtcacagatccggcactggccataatcgccagtgccgcgtcggttactgaatccggattcaatccccaagctctcgcgatagaccgtcccgatacgtttaccgtagagtaatgtgcagaatacgtaccgcactcatttctaaaaagcaagtaacacagtgcggtaagaccatcggtgcggtctctactagtccatactctatacaaagtggtatagcaaatacacccccggattttctgtaccgccacagtattagcctcagccattgttgacataactaggttcgctgcgtacgccttacaaactgtgaaaatctatagcgccctctacacgaggccagcacgccgggggaacttctgccaaaaccgtctccaggtccaaaatgtcgtggtatatgcccaattccgcgtccaagcgagatttcactagcgcgtaccacttagggcgtcgaatctcgtagcgcgttttgcggaacgacgctttgtttttcataaggagtgtgtaaagcgcgcggtgcgttttgatcgacgttctatctatccccgccccatccaacaaagcttctatctccgcctttcggagattcttaactttggtgccacccggaaacgtcgtcgcgctctttacaaggcgtaacccatacagtatttcccatgtgactttaaaaacagaaaaggcgtggttctcctccgtctgccggcccaagggatacctcgcgagaccacttaacgcgcttttcgttgttttgactgatcgtttagaggcagtacgggcatccagcagataacatcgcgtgacttccaataccgaacgaataaaagtatcgtactcattttgcatcacacgcagcatcgataatggatctaaatttttagctgttccctctaaagggttaatacccaacgaggtcgcccatctgcagcataaccgatataagtgccaccttccagacacgttgaaatcggccgttattgcgacggtacccagccctccatcgggcccgattattggtaagctgcctgatgcgtaatactgataaatacgacagaacacctcttcactataaagagcggccggcgttgcgcgacacgcttccaacatcgtaatatttataaattgttctctagtaagcggttctgccagtttagttaataattgcgcaagatcgctcggcgatccgtcatgtcttagatatttatgaataaacggctccaccatctcattgtcgatcagatcagcctggatttgaccgcaggcaattttacggaggtgtttcaaatctcgttgagcgataagggcgtctgccgttaaatccgctaagaaggcgcagaaggtttcagcgtccaattgagagtcagatccgtcaaatctgacgcttattagattcgcgtcaagtaaggcgtggagaatattgatgctgtcgctaagattgttgagggtgcaccgttcaaacaaatgcttgtacttaaatcgtgggaaaatgtataacgcgtcggcggacttgaaagtcggaacgcaatctcttctgaaattgttacacaacatattggtcgcgcatacgaattgcgccggccatcctcccccactggcgatgacgtggtttagtagcatgggtgtgaaaactggctccgaacgagctcccgatgcatctatgtaaaccaagacttcgttacggcgtaacgatcggattctacctaaagattgatagaccgaaaccatatcgggcccgtttcgcgtcggcttaatatacgcgaacatgctgtggaagtgggagctgataaaacttaggcctactgttactacggtagtgtagatgacaactcggtaacgagtccatgaatttatatcaattggtatatcacgggtggaatttaagaccaggacagaatcggtaaatatgaggcagaagcgtgccgccgcttccgagaatgaaattgtcgaggaaaataagcaaatgttcaacccgcccgcgagtcttctgctgagttcagaaaaaaacgtcgtctcagtcacgcttctatgccgagagtgggtaccgtcagccccgtgtttaggtgtgggtcgtacatgaaaacaatctgattggtcgctattcatgacggagagaagtgtatctgttcccagattgcggaggatggtacatgatctcttagaaaacccaggggctgcgtattcgcccacgatgacatgtatgttatcttctcctctcatgcttgccaacatatctaccagttgtgtatttattgtagcgtccattgctatgatcctcgggcaattacgtaacagagtcgttagtatcgaatcgactctggacagatgcctcatggttggagagtaaagttgactaatggtcgacatgacttcgtccagtatgatgatttcataccgtccgagcaagtcagggtctatgcgatgcaaagattcgatttggatcaacagtctgtaaaactctctgcctcgtatgctgtagtcactagccgtcaaatagttgccgaaccccgacagcccggcattgctcagtttgtcgaataatgtgttcgtaaaacttcgcctacaggacacaaccaaaacgctcgtgtccggattatataaaatacgctgcaaccagtctatgagagcagttgtcttgccggatcccataggcgcgcgcactacaagtacattgcgcgctctcgaggacagtggcggcggaaaagtaacgggcccgtcggattggcgctcggtcgttactccgggtctgttcttagctatccaatctatgagaccttctccgtataatatcctcgacaaagaggcgctacagacatagtctatcattttctgtgcggtcgatgctctaacgtcgccgagaccggtgctccgggtgaggattacgttctgacgaccagagaaccgtctacgatcgtcgctatgtcaaaaggaccgcgatcggaaggagcccggagaggagcagatcatatagactacattcacaaaaagatgtgggttgtccaggcggcgtgtttttctgtcgccgtcttggttttcctaggaaccctgatagctgcatctataaacatgaccgaaggtttcccatgcttttttgcggccgtcgtggactacgggatgacgaacgtgacgcttgtgcatacgggcatgaccaatccgaggctgggaggcgtagttcctgtgctgtttttccaaaccaaagccgtggcgtttctcttctattcggcgagcgtcgtttttgtatgcatcacgtgttatatcgccgtaggcgccatcataactagcaagaaacgagtgggtgctgcgtataccggaaggggcgcgttcgtcctttcacttatggcatcgccctcgacaattttgttgggtactgtgtcgatttggcttcttcaagcggtagttatagtcctagcccacaaacttattgtactagccgcggcggtttatttagtgcacttctcgactataacgtttttttatgggtatttctgtggaaggggcgttgacagtaaagtatatgcggaagacatcgctgctgcgaaaaacgtagacgccggtctgcacagattaattggaaacgggcgggcggtcatgatcaacttggtttcgatcgtatacagtatgcttctgataatggcgtctctaatgttaggcatgttactagcaaacagctttaccttaaagttttggcatgtcatcgttaccgtcctcataacttcctcagtcttaaccctaatgtatcttttagtactcgagttcctagtggcgcggtacgtgcacatgattttgggtgcgtacataggccttctgatcgcctatgggatgctctggaccacctcatgtgattatgtcaaccggttctacttcgcgatgggcgtaggagccggcaacttacgcactgcctgtcacagcgtgctggcgtttttcaccgtactgattgtagcgggcatgattgttcgcctaatccgggccgggttgtatcaccgtaggcgatctactcgtgcatacgccaaagccaggcagttacaaagaaatgtaaaggagagattgagacgaatgagtcggggacgcgatcgtcccgatagccgagctgaggacgagcgggcgcttacgcaaacccaatatagcgaaacatcagacgacgagactatatatgatcgcgtttattcggggtctgatagtgaatgggatgaataggaacgcccgaaacataataaaacgctaaatctacaagtgattgtcgcgcgacttatttatcactataacgtatcgttacattgttcccgaccgtccttaaatctgaaaagcgtctttcctctcgcgcaagtacttccagctaagacagtatcggaatggataagagggtcggaggacctaagaccgtccaaatcgacggtatcgtattgctcgtcgtcgagctcaattacatgtcccgttttggtcagaacggtgtttcgtttccgacagcgtcggaacagttccgttacggatattgcttggcccatacttgctgcacgagttcaccgaacgcacggtatccggcctcttctacttcaccgtagaatgtaacgtccacgaccacgggagtgatgaggaggagaacgggaatcgcttgttcggggtctattttgacgcttggagtgggttctccagtgtttccttcggagatcgtcaggcgtctacctaattcgccaggtcgtctgcggcggcctataaacgtggcgaggtgtgggatgaccgggttgctttcaaagtaattagaagctacgtagttctgaacgaaaatctgcttgaaatttggatgtcgtgggttggcaaatatgggcacaaggacagattgttctccggtactccagcatagcgggtgtatcgcgttcgtttgcagatcaggttcgccaaacagccatacgcgagaactgcagttcttattggaggccaagtgacgcgaatcaaagtcgttccgtttaatgtttgatgaaatggcgcggaagcgtgatagccccactttccagtcgtcgtcacatgtgattagcgcctcctttgccttaggaaaatcgtcaggtttaaaatagtccacgcaaggatgattgatggcgtataagaatcttcggagcgctgcgacggttcttgtttgtaataggcgttcgtaacattgagatagctcgcttcgacattccgggtaaaacgcgtatttggccctacactttatttcgtacgtttctatggagtggtcggggagggcaggcgtaaggattccgcgtgcgctgcgagggcataccgccatatcgagggatgctccgagcatcccggttctggcgtctatcatcagaccgcacgcgtatttgtcagaggcggatgagacggtgattgtctcgtccggtacgcgtgcattttcgagcacccgagaaggttcgcgaggcctgtacctggggttctccagacaataggtctctatgagcgctctcgcgagcggctcgttacgcgttccgaagactacgctttcgggcattccttgcgccgtgatttcggcaggtcttatgccaacggtgtttatccgtccatcggcggtccacttcaatgtcgatgcggtcaacagccattgtctaagtacgtgccatagctcgcagtccgcttgcggtctggtgagagtttctacaattttacaccagaaaagcgcatgattagacggcgacgttgcatttgcgcccgattcatacaggagcttgtcttccgcctctaggagagaagaatatgaagatgccggccaacgtccctctgaaatgcctcgtttgataacgtccgttatgtacaataagcggtgatacagcgggtgtggcgagggccccgattgcttcgggtcgacattccgtaatatatagtcgctgaaggtataatcgaccacaacactgtagcatacggtatcgtaaggtttggactgcactgcttctgcgtgctcggcgcaagcgaagacctttggacacgatttaaattcggactcctttttacgtttccgtggcccgttctcgccgagacggaacattgcggtggagtctatttccataacagccgtgtagcggccctcgcttctgagttcgagtgacagtaaagtgcaacgagctcgaaaagattgcttaaatatggcgggactctcaatgaatcaaatagcttcctgtgcgtcacttcatatccttctaaatatttctcaaacgcgaccctgtggtgagagccgtgtagctgcgaacgaatcttttcggctcgttcccacgggataccgattttggcagttaacggggtagctggaaataagtactggtacagcatacaccgatacgctaacatgtctaaaagatagtcggccggcatcattttatggtaataaaaatgcaccgggtttccggggatggcaaagtcccgcgtaaaattcatcccggcggctagaagcacttccatcagtgattggcccagtgcgtacatatctatagcgacaccttcatcactggacagttgacttgaaccccgctccaagcccgtcccgtttaaggctttaaccagcaattcgcagggctgcgtttgcccatgccccagcactaaatcaaatacaggtctaatgtttgctctagacacttttactgaatatactcgatcggagtctacagttatgtcgaatcgggctttcgtaatggtggagtttgtgttaagtaacgccaagctaaaatcgccgattacggcctccactataatagggttagacccttccctgacgttgacgaaaatgttcccgcacttaatatccaaatgagtcagtccgcaggacacgttcaagtacacaacggctctgccgaggcccatgaacgctttttctatggccctccaatggcgtgcagttttatccatcttcctcagtcgatggcagtacgagtccatgtccatgtcatacgctggaaataccagttccctggatggtatcgaaaaggccagtaatgaaatcacgctattgagcgctagagttgaccttgcccgacaagcgcattcgccggctatcagtgtcataagcaattcggtcttgaaacactcgaacacctttttgacggctacatttgcacccttaaatactttaacttctccatagctcccgcttcccgcatatattggcgtttcttgcaggtcgatggtgctgtaatgtaagcccggggagatatcgaaaatgagcgatgttatattctttatgcgagatagagtgaaaatatgatccggcaaagatggtcttgatagcaaaatgtcagatgttttcctagatatatgtttgcgtctcctatagaattgttttaggcatctcctaatgttgacggagatgtgttgtttgtggtccttttttctacacgaatctcttcggggggcactgaatgttccctgcagatcgtctgttgtgcttgagtatcccttaggcccgctgaagtcttcttggtcgctgatgtcggaaagccatttaacgtgaggacactcgtcgttttcgcggccgcgccccggctttctggctttgaggtcaagatccattttgacagcagcgcctcgcactctgcgtccaattctatgtctggaaggcgatcgctgatgtcgtcgctgatttgcgttaagatgtcttcgtttgctagaatgtcctcttcggcacgatccaactgtgactggagcctagggtttaaaaaccttcggttcgcatctaagacgatgcggcggtccacctgttcgtctatgtggcgttggataattctcgactttctatgagcttcttcgatccgcatgttcgagtgcaactgggttttgtagtcactgtgggcgtttctggctgacgttaacgcttcgatgagttctgggtcgtccgcttctacaccttgggacaaaagtgtcaaggtgcgttccttataaattttctcccgcgttcgacactcggccaatatttgacgcctgcgtctgcgtattgtgttaacggcgaacatcgctcgacgagattcgtagtctggcgattaccgactccgtaaagatgttcggaggcgcgctcggagaatcggcgaagaagcactttgaacgcctgctgagagataggaacgagcgtttaggtgcgagccgtaaaaatgaatgcctcgcgcgcggcgggagtttagtcgacgccccctttctaaattttgcgatttcggtcccaaggcgacatcagacagtgatgcccgctgtcggtacattgcatgactgctgcgacggtactggtatttactccgcgatcgctacacgcctgctgtatgctggtatcgtaagcagcgaatttggtgaagtgcgacgcgagtcgttatctaacggtcacatatcgaaaaggaatcgggaggcgttgcttgcgccgactctgacacgcgtcgccaattccataacatttcacgagtacgacgatgcacaatgcgcggcgcatcgcaacgcgtattacagtacgatgaacactttcgggtctatgaggacatctgacgcgtttcaacagctggcgtcctttatcgatcgattttcaaaattattagctgcctcgtttaaagacgtgaatattttggacagaaataacgctcccaaacgagcacgaataaccgctccctcgtacgataagcctcatggcacgctggagctgtttcagaaaatgatactgatgcacgccacttatttcttaacgtccgttttacttgaagaccacgcggaacgtgctgaacgtttgctccgtgtcatatttgatatcccagacttttcggacgcggccactagacatttccgacaaagggcgactgtttttctagttcctaggagacatgggaaaacttggtttttggtgcccttgatagcactggccatgtcgtcttttgaaggtatccgtattggatacacgtcacatattcggaaagcgatagaacccgtttttgaagaaattggggatcgtctcagacgctggtttggtactcagtgtgtggatcacgttaaaggagaaaccataacgttttcgtttcctagcggatcgagaagtacggtaacgtttgcctccagccataatacaaacgtgagtattgcattcaaaaccgttgtgtcggatggtcccccccctatacacacacccgtgatagtctaatacacccttgaaccagtatcgaactccacatctccggcaggtagaccaaatgccatccgcatgaatttacgggaatcttcctactgtctacctcggcttcgattaactcttcgagccgttctgtaatgcacgccttcgtgccgctattaccgaccactcggacggcatttaccgtgtccatgaataaaacgcaacagaggcttttttcccctttgacttgtatatctgtctgtcgggctttcatccacatacacggacctctgcaaacacaagcctgcccgagcgatccgcactcccatctcacgttacaaacatccacgtgaaggtcgaaatgcccacggcattccgcacagccgctccggtggttaagaaattttgctagagtagcgcccagagaacgttgctgccaaccggcgggacatatagatagcaaactctcttccatcctgaggtaataaaacctgcgtttggaaagggaccaccaagctccaatagatatcgctatacagttgtgtggatcgtctggcggctgcgtgcgttggactagggaatttatgtccggtgcgatacaagagatagttgacaaaggttctatggcgacgtccggaagaccgatacaggtcctactaggagcgacgtcagaaaagaaaataagatctgcggaagatccgtcgcgcagaatgggggttatgcgtaaagcggcagtcacggaataggcgcgcgtcccgttgactaagaacaagagttgaaaagtgtttctgtccaagtacatctcctttggtcgcgtaaggtacatgaatatctccacccatttcgtcttttgcggccgagcgcccagcggtacgtacgtacataacgtaaagtctaacgtggttaatgcgaccaacacagctagacgcgattcggcccgaagcgtgcgccatacgcaaatgcggtcatttaacttattaacgaactcaactgccgccgtatcgcaagtccgttctgaacgacgcggcgatccgggcgtccttcgtcttcgcgtagtcatcgtcccacatctgtatgacgctaccgctaattgaatattcgagtcttggcagggcgctcatggaaaagataatgtagtgttgctgctgcagaggcgcgataaaaccgcgtccgcccgcgccagaggccaattgaactcggcgccggcatgcgctgctaacatgaaccccgcgggcaacacgattgcaacgcgcatacgttcatcataacctacgcaaatatacgcataactttctccaggaagaaatctttcacacgttgcgcgcgatacgaaccattcggggaatgcgcaggttctaatagattcgtcgcccggcccgccgggcgacaaatgcgctgcgtcacgcaaaataactgggataggcctcttatttaacatcatacattctccgcccgcgctataataatcaaataggaaaagattcggcgtcctagtagcgacgggttggtagtcgcctcccaggacttcggcattgtttccagtcgtatgtatgtaatatgtttttcctccagtgcgcttaacatgcctggccagaaacgagatgctcgcggacctaagagcgcctactgaaaacttctcaggcgaagaactcgcgattgcctgtagaactgcgcgtactgaatggggtgtgcggcttgcgatttctgccacgcactgaacgtctcgcgcatacacgtcgtagctgatcagctgatatagattgggccctgttttcaacgcttccccaactgcccttatgacacacgcagagacatacgacttgaaattaatcattaattcggtttcggagcccggagaaaacgcacgcagttggttttcctctgcttttaataagggagcagccaaaataggagcttccgttgcgatttcggtctttcttctttgtggtagacgagaggggtgatcgacgccttcttccatacaagcggtagcgagtaaattgctcaacgaagatggaattgtggcagaatcggaggaacggccccctaaggcaatcgaccgctcatacgatataagataaagtgtttttttggtcatggagtgggtacgtggaacgatggatatgcccccgcacctccaccggttcgcaattgtgagcccgtccgccaaaatgccgaccgcagaagataggaggtctttggggcttaacgaattttgcgatggttcatcgaacatgagaatgtcttccaaattcaatgcagtccctgtagattgctggtccttattacggccctccaagcccctccgagtgtcgtggtttctggcaaaccttcctttgcccacgggctcgagaccatctatgacggctttctgtgacacgctgctactgggtgtgcacaaattattttccaaacaagctatcgccccttggcgcaatccggacactacgctggcgtgtatattctccgccggccgttttgcgcttaccggcgctcgcctggtgatagcctcggctgccttcttaatgagatttgcgatctctatattgtctgtctctagtcgcgtgtcgagagtaggagtgtcgaagacgttcggagaatctgttacttgccgcataatgtcaaactgaccgggcagttcgacggcggataaacacgcctctaatttagcccccaattctataacagccgacggtaattcgacctcgtatctcttagtatatcgtatgaattgacggaagagcgtctttaagcggttcgcatcgatatcgtatcgagtacctggaggaactaattcctcttgactaaacagtaaatccatgtacgcttcgtactctccggtttccctatcctgtacgttaaagcgaatagccacggatgtaaacggatcaaagcggttcttagaatcatattgtatgggaagactcatgaacaatccaccttgatcgtttcgattgagcgtcgcgaaaagtttggcgtggcccgggacatgaggtatcaagagtatgtgtagtgcgccagagggaacgtaggctgccggtgattcgcgccaaccggaacatttaccggtggcattatagcgcatctgaacacttaccggaatcggcagcgattggtaagcactgctgggtactctctgtgccgcatccttaaaacgggcgatatctatccccgctgccgacaaacactcatccggtaagaggacatgcgtcagtacgtgccgattggggccgtgtttgggagtagatagcgaatacgcggtctcgctctctatatgcgcctccatcctgcaccggaatggcgagtcgggtcctgcggtctagatagcgtcgcgtcgccgttaatgcgaggggctatgcctttacggaccctctcgactcagcattgcttgtttttgtttctgcagagcattcgcggccaagatttcaacttgctctttgtcgacgaggcgaatttcatacgtccggatgccgtgcagacaataatagggtttctgaatcaagcgaattgcaaaataattttcgtgtcgtctacgaacagcggtaaggcgagcacgagtttcttatacggtctgaagggatcggccgacgatctcctaaacgtggtgacgtatatatgcgacgaacacatgaaacatgtgacgaattatactaacgctacgtcatgttcgtgctatgttctgaacaagcccgtgttcattacgatggatggggccatgcgtcgcacggctgaaatgtttctccccgactcttttatgaaggaaataatagggggtatcaccatggatagaaacacgtgccagggagaccggggggtttttactgcttctgctgttgagcggcttcttctatataggccgtcgactgtacggaatcaggatatcctctcgcgagacttatacgtgtatgtcgatccggcgtttactgccaacaccagagcctccggaacggggatagccgtaatcggtaggtatggagcagattacatcattttcggccttgagcactttttcttgcgggccctgacgggagagtccgcggatgccataggagagtgtgccgcgcagtgtatcgcgcaaatctgcgcgatacactgcgagcgtttcggaacgataagagtggccgtggaagggaatagcaaccaagattcagcggtagcaatagctactagaatttcgatcgacctggcctcgtacgtgcagtccggagtggcaccggcgccacacgacgtttgtttttaccacagcaagcctgccggcagcaacgtcgaatatccctttttcctcttacagcgccagaaaactgcggcgtttgatttttttatcgcccgcttcaactcgggtcgagtactagcttctcaagatttggtttctaccacgattagcctgtccaccgatccggtcgagtatttgaccaaacaattgacgaacctctcggaggtggtcaccggcgcgacaggcacaagaacgttctctggcaaaaaagggggctacgacgataccgttgtggccttggtaatggcggtatatatatctgcccacgcgtcggacgcgacgttcgctcctataagaggagtcgaggccacgtgtcgcggcccaacagaagcgtgaccggccccgaagcgtgaaatatatctgccgcgtcgcaggaaaagctaaccaataagcagactcgcataagcacaaaccgtttattagaaggctacccgatgaataaagttattttaattccagttagaaataacgggacataggtctccgacttttatactcgcgggcccgtcgaacgtgcacactttcaatagcgggcgcagcgctagcatgtcccctagatgcagagccatggtaatccacgaagacagggcttcgtaaatgggatatctgcgccacgcgtcttgcaaaggcgggggtctcggaattctgatgagctgacctactgctctcgtggccgtctggagacccaccagggcgttgacgtaaccgtcagacgctcccaaagtaagcaacgtcggtatcagagcatataggagcatgttaccttcgtcgatagcgaaaatcatgtttagcaataaggttctcactgcagactccgacgcatccagactatggagcgtcggactaatggtataggttttcccgttatatgtaatggattccgcttcacggctcgtagggggaggcgctagccctccgccgatcgctatcccttccgtggctcgagatagcgtcttagcaataatttcacgtgcgagtctcgccggaacggttgatggaaataaaagttcggtatcgatcgattccaaccggatacgggagcaaacgttagggaaaagcggaggtatcaggcatacagcatccccgttacataggtcgaacgggccggtgttttgaagtgccaggcctgaaggaatggtccccattcccaaaactacagcactcattcgaccgggtagcgcgcgggtgacgacggccgcaaatcgtcgtttgtaggtcgatagcagactcagcgtatcaggttcggccccagcgatgtagtatgacttataatctacttctttgagcagcactctggctctgacggacggtaaaaaaagaactcgcccctcacatcgttgaagtaggttcgcgtcgcacgtagaaagcccgcaggggagctcgatctctactgtcgtaccattagaagcggccataacggtaccgctggcggtttattttcggtaccgacggcggcagcggataagtgtataggaaccaggccgagccgctgtcaggtcaagcacgtagaccgcggaaggttagcgatcggcgagctggcagttcagcatgcaggcaagcatccaccgatcggcgaagcgtctttgattaagtattgagccaagtgcgtttctgggttatccgcaccccctgcgaaatacgtgcggagcaaagctttgtcggtagcgcaaagtagcggataggcttcctgaaatagggaacaaggatcttcgattaattccgtagatccgactggtcgtttgaactgtacttctccgtccgacgcgaatgctgccacggcagaaccggcttcgctgattagtttatccaagcaccggcttttgcagcacacttctgccggggtaaaaaatttataggtgggactgaagaggggagacgccccgctcaaattgtaagttccgttatagagcttgtccgcgtaagagaatttttgcgaagcccacggattgttggttgcgcggaacggataagcgggatccccctgccggtgatcgtacatgagtttctcgatatcggatacttcctcgtccgaatgtatcgccccggccgccctccctctcgggttacacggggttcgaaagtactccaggtctgcggaaacgggtgtagggatgaactcgcatatggacatttggccatgttccagcccgtcggggagcatgggcatcagtgtacctagaaaggggacagttctttgcggagctgttctctgtccgcgcgttgctgctttccgtagaaagtcatcggcttcggggtttataagggggggcgagccccgtgtcaaatgcaggctttggacagtgttccccatatccgtcgtagcgtttcgtaagagtaaaggggtacaagtggccgtataccccacgcccaaatcaacgttagctcgtggttgtgtcagagaaaactgcaccccccctgcgtgcgggcgcttcgagacagacacctgtccgagaaaaaacgattcggacgcccgttcggcaaacaggcccatatctgctaggaacctatcttgtcgtacgacggtaaatgcaattcccggatggaaccccgttctcaactgatgatacaggcctataggagtgagtttgaaatatcctgccatcagcgcgtacgacatttcgttgggcccgcatctactttcgcatatgtactgtgccacgggctggcggaacgtagaataataattggcgcccaaaaactgtggaacgggaggagctctgccgagcagcgtacgcgcgttcccggccaactccccgactgccgttagatggtcctgacaggcgaacaaagcgttaactggaacgggatagaagtacgtgccggcagcgatcgtctcatcattgcatgggtaggccatcattaaaagcccatggtgtaacgcgccatcgaacgttcgcatatgccttgtcgccgatgacgtgccgcctacatccggggtggttccgtagagaatcgccgttgtccgctccgccatattgttcaccgtttcctgcagagttagaagcgcgtccgcatccaccaatattctggcgttgtgtagcagcacgttaaacgtgttggggacaagatttctagcgttcaacgggtgcctcgggtcttctgcgcccaggggaggctcctcgtcgggttggatgtcgggaatgatcacagattgagacgtagcgtagatgttgtcgaaacggatgcccatggtgcaacactgacccctggaaaatgccgggaccatcacgtaataataaattttcgataggattgaccattcatgggtatgatgaggcgcgaacgtttgtcgatcggcgtctcctacaggcctgttatggactaaaacgttgccggtgcgttcaaaatccgcatcctgcaattccagccacggccgcacagcgtaattttcgtcgcttcccacgttcaaatacaagtttctatcgcgcacgccgtgcgcttgatacatcagggggtcacagtcccacagtagggggggtaggatcgctctatcgattaaggcgtggtttaattcctcattactctgcccggtcagtgagtctgtctgaacggtataatcctttacaatcgaccgcagcgcgcgaacgtgccgcatcagctctttgtagatattcgtacagtcctcagggagttcaccgctgcataaataggtatcgatgaatgcgaccatgtgaaagttattgacgaatgctactcgtttgcagttgtcccagtaactccgtatacattgaatgatcagtcgcatcagtataccgaaattacgttcgctgccgtgaattacggcttcgattacataaaacgcagtggggtagctaacgtctgagaacgttgcacatacggcattgattgtggaagcgctcattttgtggcgactggatgcgagctcttggccgagcgcatctctaaagtcgctactgcagagaggtagcggaatattacagttgcaaacccgccaggaggcggcgatcgacgccatcacttgcggaacgttatgcggccccgggagctctacatctcccgggaccacaaaaaagtcaaacgcgggatgcaactccatagatagatgtggatttccggccgataggaattgctcttgactcatatggcattcatctacccaccggggcgacccgcagagcacgtctccgatgttctcgaaaaaccgacggctagcttcccgtagaggcaaggccggcgggttcgtcacatacgccccgaaaacacacgttaaatcgcgtctgtcgcgacgtaaatgactaaccgtcgcttcgatatccaaaaaggatgagtggcacacggttccaatagcatccgataaacatacgctaattatctggttgtctttgttatggaaatatagctcccgtggcgggaacccgcgcacatctccttgacatccaggcccgggcgcatagtccccaatatgccgcgcataacggtccgcccgtttctgatatagtcccaaaggcatcacgaacgttaaatctatgtgtccgattaaagggtactggacttgcgttgcttgataaacgcgccgttccatggcttctagaaaaattaacttatccccaatggtcaccaattccgcaggcacttctgccgtttgggggacatcgtcgtctccccgtacgacttcatctgtacgatcgatgatgtcgttttcgtcgagattgagaatatagcgtgcgatgtcgtccatgttgcgtatggctttgcccatcactacggcggttactaggtttgttcccgatattatcatttctccatatgtaacgggcaccctagcagacgtatccgccatgtctagaattcctgatagcagtttttgcctcaccatgctcgttgttactagtacgccatctacgaggcgccctttcgaatcggaatgggtcagcctcggcattgcaattgtctgatgagtagagttaaccatcttggcgaggaatgagactatactgtctttgctcgcaccggctttgctcatgatgaaggtatcgttacacactctgcgtttgagctctgataccaaattcgctcgcattacctgcccgtttacccttccttctgtcgtgctgcgcgaaaggggtatcagtagcggagtcggcggagccttttccatcagtattctaagcatctgatcgaccgtgccccgctcaaacgaatccaatatcgttctcacgtttcgagctaattgctgtatggctctcagtctcaggtggttagatattgccgttccatctaaagatacttcagataataatgcgagtgcttccgccgcaacgacaaaggccgcgcttaacgatcgcttgcatacgcgctttaccatgtaagtgtaaagcggttgatcggcaggatggggcccctcgcgcgcaatcatgggttgctgtatttcaaattgcacggttccttcgcgcatgtatagcagatcgggagcacgcgtgcagacgcatgcgactgagagccccgtttcgagaaatctgatcaaagacaatgtattgcagtaggttccgagaagaatatcgaactgggccgaatagcgtccgttgtcatcggaactgaattgtttgaaatagtcgaacatgcatcgatgggatgtcatttctatagcagtcaggagtctacctgtaggcgctaacgttgctcctacgttgaatggtgtcgaaattgcacacggtgcgattggcggacagtcggtcgccggaggacagcggcatccggccatggtcgtcaacgggccgcgtccgatgtaaggactaattgccaccgtgactatccgatgctatgcgtgatccagggcatctagtaacgtttggtcgcgtcgaaggtcacgttaccggctgttcgaatgcgacgcaaatgatagccgatattgtaggagagacgtgacgtggagaatgcgcgagttctagcaacacgaacgaaattgcatattagactttaacgatgcaggtttttatctacacaatgaagtcgcgagtgcgcgtgcccttatatgtgcaagtttccgcccctaatcagaacggaacgcacgtctttatcagtgctcgtgtccacaaacgagggaggagaaatcccagtgcgtccgacacagctactgtagcgtaggtgatggtagctcccattaacaggtataccacagctccgtctgtcttatcgttttcctctaattgtaaaactttctccatgaatctcggatcttgaaacaccatgcggtaagaaaatactccgaatatcaccgcccccaacgtagacagaataccaacgaagatttgctggcagttatccataggcatgacatcattctttatgtttctgtacatgtaataagtttcgaggagtaaggtaccatagaacactgcggtaatggtcgcgcccaggatcagaaaacgattgtcgtgcccgtccatcgcgtacaccagaaatataatacaacacgagggtcggagaacaaatgcagatagccaagagagcacaacataccgagtaaatttggggttcatgtcacagcttttcgaaatagtgaaaattgaacctgataagtaagaggacatcgtggcatactcggccgcatcttcgcaatcgatatcgtccgaaacgcgtgtaactattgactccgtgtcttgcatattcgtctctaactgttcatcgccaatatagtcgaggagaatatcgcaatcggtcggttttgttgtatggtatccacgcctgtaccaaggcatagtgccactcgagaaggaccgtttctggccacacgtaacgactttgtcttctactaaagaccacccggactcggtacagacccaagctagagctcgagaccgcggaaaatggatatcaaatacgaacagaagatcttgtatagaaacgtccacttttatatctcggaatgcggccgcatagcttatttcttctgcggtggttgtctcatggcggtcgggcgaccgcctaccgatgactcgcaggcagagtttgcaaaatttgggctggctcttcgaggcgatggagagtctaaacccttggcagcttatgtacggcgggaattgcttcgtagaggaatgaaatgggcgctgcctcccggcgacgatgaattattcatcgactgtatggcctttttgaatctagacggggcgtgcagtgaacgtgagatttgcgatcttgtttgcctggaaacgtatgatccggagatcacaaaacacatggtatccacgaacgtcatttctggattgttgatccagacggcgcatgagtcgccgcgggactgcgtgatccacctgcccggggccccacaagttacagacgcacattccaatgctgtgtacgaatgtaattctggtgcattcgtgctaacttgcgcaactttggtggaactgcccacgtctctgaacgatctcgtcgaagggttgtttgacggtgtccccatccccagagatgcgctctcgtcgaggtcgcttagtagacgaacgaacgtgattatcacgtctaccaaagccgcggaaacgacgactatacagcggatgcatgtcccgcgacataaacagaggggcaacttaaacaccatcgcagctactttgcgaccggtgaaaaaacacgcgcggtttagcccgttcgtgcaagtaaagtatatacctcgcgtactcaaaatatggagttgtgattcagatagccattcgccgtccctaaaggagttgcgggaattgttttgtaaagtggacatggtccgtagagaaaacatgtacgcagaatcgcaattggaaccagagtccgtcacaagtgaactggttctgatagtcgatactgtatttgggagaccgctcgcaccatttattggcgtcgggtcggaaaacatacgcgtctcacatttccaaaagttcttactgctccagggcgtccttatattaaatcgtttgccgaattgctacggaccgcttcgggagctgtgcattcagcatgcacctgccggtgaagagtcgcctcctctggtatccgactctgttatcgcagacatggcgaaccatatgtttagggtcgccgtatttattggcatggttgtggaaatagttgcgggatgtgtatcttttgcatcagaagaactcgaaacgcgatttcccagtgcgaccgcgtttacggatgctggcattctactgaacggcatagaagcctcgccgaagccaaattgcttgtcggaacttaaaacacgcaaactcgctcttatcctggacggtatttatagagacatggatcctatagacgttgctctacaggaatcggtggggctaaatacagcagagttattatccgcagcaatagatatctcggttatgtctgcatttgagcattcgggatggtgtagcggctacatggaacactttgtttcattgctagatgcccgtctgagagagggagggtgcttggcaatattccggtagctttgtagcacagcggcgagacgcgcataggcgtgccgggcatatacagaacgtaagccaagctggagtttgtgtaagtatgtgctctacagcgtgcgggaagggcggttcgcgaataaacacaacagtacaggttcgacggttagaaagtttccagagtttattaattagattggcccctcaagatcgtctttgcgtcttaatttctcatatccatggtacctaaagttgctgacaagcattttggcggtgacaatcgctatagctgcggctattagtacacccgctgcagtagttgcgatgtaggtcgccgagaggatggcaatgcgctgcgactcaaacgctaggatcctcacgactgtgccatttggatacagcaatagtgacgtgccatacaggttactggtggtggggttgaaatagcgcacggacgaattgcctgctgctagcaattcccgctgcaaatcgcgcgatgagatataaatcgcatgtcgaacgtggccgcttgcggaatatcgcagcagcacgcagccgcaatacggacattcttttcccagaggcctaggtaaaaccgcaggactgattatacctgatgtcgacgtgcacggcagcctggcatatgttatgtaaagttggttgtttacatcaacgccgtctacggtatacacgatccctctgaccccggcccgccttgttacaatgtagctacctataccggagatgggtaacaccagaagagtgtcggattctaacctatcagtgcccgaacattccaaaacctccgacgcgtatgtagcaactgttctccctattgatgttcgcagctttgcaattactgattccgccttggcctgcagatcttcttcgattctgaccccctgagaagtattctctaaatactcctctattactggacggtaaaccacattggccatcgcgtataccctgtgacgccgctcggaaatgtcgatcctcaatgatgtcatgcacggcgtatacgcgtccaaaatatgtacgggctcagtgctgcgagtgagtctgatatacatgtcttgcaccgttaattcagcggccgcgatgtgttcttcagtacacatcgatgatgcaaataacagagatttgcgtgcgttatgcgatgcgcgccattccatcggcgaccgctgaaaaacgctgtcgaatgcataatacagggcgtgtctcgtggaagcattccacgagatcgcgtccctgacggattcttcgtggagagacgtgataaaatttagtgcgaggtcggaaattcgcgccccccattcgcccttctcccgaggtatgtcgaacgcgtacacggaccggaataggtacaactgtcgcgcaatacctaaagaatgcgtccccctcgatacatcgctaattttttttttcaatacggatgttagtatagcagctttttcattccatacatgtgtccgcgataataagaagcacgtgccggggtccgtgctcggggcaaaattgcaaagtgccgcggcgattactttcagatctgcctcccttttaattaattcatcgagggagacgtagccagacttaaaagcggcgtgtacggacgcaacaagcgccagaaacaaacgcgtcgttacgatcctaaagccgtggatataattactagtagatgcgggcatagaggcagaaataaaaagccgggagtgcgcttgagtgatatgaagattataatctaataggtcatctacactcgaaaccatatctgcgtgggcctttaattccatatccgaggcgttctgatatgttcccagtaggtatgtcgaaaggagatgtcgagaggatccgttcatcgggtcatactgcttcatcggtggccacagcaaagtcatgttggtagtccccgacgataatattagttccacaggcgatgcggcttccatagagatcgtaacggaggcgaattgcactcctaccttcattaagacctccgcggtatttgaaccgaatatcgtcgtccgcacgtgggcataatctgtcgggactagtgtgtccatggggtccacgaagcatgcacgctttgcaaaagctcccgataattcgctgttgagaataaaacggttctccggagtgaagaagtcattcggctttatattttctaacactgttggcgggtttgcgccagtaggttgtgacttggcaccaccgtgagcttttggaccgggtttgtccggtgtctttttttcgtctcgtcgatgggataatacggctgccgtcaacgagtaatcgaggtccggcttcgcgttcaaaactttgatcaggttattagacgttagcagcctagatatcggtcgtttgaagaaaaccatttgcttcacttcacttattggtaaatgaaagagaatgccgctcgccggcgtagatgctcctatatatacaaatgtcgcattgtcgcgtacccaggacgtcgggctagtagcattttcatcggccgatgaaaagtccaattttacggacggcggtctccggatgtctagcagcgaccatacggaggggatattatccgaggtgggggctcccggggaagatgcgagcgctagcagtaataaggtgcataccgccattccgattacgcggcgtcggtcgttgcctctgcgtatcgctagttcgagctcgggtttccgaagcaacgtaacacacatatcctatagtgtacaatgtttcgatgcaactgaaagcaacgagctaaagcgaagatgttttgcaggcgacaagggcatgcattaatgcacactcgtccgaaatgtcgtagtctcaaatgtccatctccttattgaatgcctgaacgtccgcctcgatctcaaatacatcattccagctcatatgcgttattaatctttccgccattgaatccataagatactctgcacatttctggaccgacatgtcgctgacatcaagccgctcgacattgatgttcctcagtttcatcaacatcccccacaatatccacccgtataccgttaacaggctaccatcttcactgcataattctttccgcttaaaaattggcaaaagcgtgtgctgcaatgacacccggctaccatggtaacctgaacggggaccatctataaatgtagaggccatcgatgcatcaaaccacgggagctgcatccactctgtttcccattcgtctttactgtaaggacaaatgcaattcgcatacgcgacggtatctgctaaagccgaatatgccgcattgagcgccctgagcatgcgcacgtctgtagtttcccccgctctgttcctggccgataggcgcttcaggtgctcggtttcgtcgggcaaatgtgctattaccaagttgcagccgggcggttcgtggggcaaccgtgtaatcgcactaatcaacatttccagagaacaatcgccaatcagatgtcgggcgatgggaaagcagacggtagctgaaacaggatggcgatcaactattaatataagagatgggttgccccgtgttccggctaattgatgacatttagatgatattcgttcgtgtagtacaatgaagggatcggcaaatttggcctgcaaagccattacgatcatgctagactgaaatagagataattctccccgacgccggcgttcggaagcgtcattcacagctgcaactaaatcggtaaaatagcgacgccaatatttcagaggctcaaaaactttcagcacgggtactcccgtcgcagagtggctcggcacttcgtttaacatcgacgttttacctatagccaatggcccgtcgaggtagacgcggatcagctgcgcggatgtcatctgagagggcattaccgaccacggccgcacgtccgacatgtccggcgcgcaagaaaactgctcgtagacgatataaccggcggagaagcacttctggacgctcaagttaccgtgcggctgttaacctcaagagaactctagcggccggcgttcgatgtcacgcacgtttttaccaaaagctctacgcagaatctatgcaccttcgaactcaggccgatgattggacggggcgggccctatctaagattttaggaaaaattatggggtttgatgtatttaaagcggcaactgatttccgattggtctttgaagtaaatctggggcggcgaaaaccggactgcatttgcatgattaggtgcccccgcggtctatgggaggcaagttgtgatggcgcttgcgtcatcattgagttgaagacttgtaggttctccaataatctaggaacggccagcaaaaaggaacagcgcctcactggaacaaaacagctcttggattcaaaattgctgattgactatttagcgcccgtaggttcggagcgtattttcatctgcccgttactagtattcgtgtccaggagaaaattaaacgtgttgcgtgtaacctgcctcagaagaaacgtcgtaagtaccgatttccatcgtctcgcaactttaataacgcttgcatcggaatataagattaaacaggtcgacaggcgcagaacggctgttcggaaaccggctcagtgtgcaagaaatttcgcaagtcttgagaacgcgcggcgagacgatcgatcggaagaggtcgagatacacacttttcctaactgtagtattgtcctaccacctcgtaccattctacccggagccgcgaatacgacaatgcaccgtttggcaagtattgttagctgcttggtacggaagcagtaaccgaaatcaacggcaccctacgaccagctatgttacacggtgcaatccgcggcccttctcccgttactttcttgctccgcagcccttgtccaacgtcagttgtccgtaggcactgcagcaaagcatggcgagctttgcctgggatgcaagaattttgacagacccgggcccggaatctcacccggctgatgtaaagaatttcatagcacctccctggcctctgcacttctggagggaacctatatttagcggcaatcttggggatgcggaacggcaactggcaatcgttaaggcgcgaaacagtgccgcgattgcagcgttaactagtttggacgaccgtactgatttaattgcggtagaagtggagcgtcggcttcgaccactagaagataaaatggaacagatcgcaacgactttggcggatttggaacgagctgcttctgcggctgaacttgccgacgccgcagccgatgaggctcaaaatgtcgtcgattcgaacgaatgccaaaaaaacattggtagcgctgcgagtcgcgaggtccaaatagtcaggaacgatccgtcgctaagatacgactctaacctgtcggtggatctgctgaatattatctatgccagcaggggcgctgcgaattcgggagtggcgttcggtacatggtaccgtactttacaaaactcccttattgcggaaaatcccagcgctgcgcggaagatagattatcgcgatggaagaatgtcgcggaccttcattgcaacggcgataacgtccttacagtcatgtgggcgcttatatgtggggacgcgtaactattcttctttagaatctgcagttctatgtctgtatgcgttttatacaaaaacgggagctaatgtgtcccatccaagttcttttaagagtgcattagaatctgttcccatttatctggatcacatgtcagcgagcctcgctagcactgataccaggcaaatctacgggttcgataccgggaaattgccgaaggatagtttcgccgccccgtccggaaaatacgaacggggcgcgctaagtgatcatagcgtattgagagctctagcaaattctcgcgtgttgcctcctagtgcggggtcgatcccccgtggagacgtagccccagagctagatgccgaccagagcgttcgtaacgacgaagtcaacgctgccgccgcagcgctactgggacgagcccaacccctcttccttatggaggatcagacgttgctgagagccactttggacacaatcgtggcattgcttttacttcgccgtctactttggaatacgaatatatattcagctagagttaaaaaccagttccaactgggggcgttcgttccaggcgtgcctccagatttaaccgtaggagcctcagtagacacgccgggggatgtaattaagagtgacgggagaaacttaacctttttatttcagagatacgtagttcccgtatatagtgttgtcaaagggatagagctcacacaactctttccggggctggtagcgttgtgtttggacgtcccgttttccgatcgagggttatatagcaccaggacgccgccatcgcgtatcattgacgtttcgctgagtaaatatcaggcctccctcgtgaaattgatttccttagagcttcaaaatcgttcccgcgctaatgttgtatctgtttgcgaggtgatcgcgactcacgatttggtgactctgcagtatgagcgaggcttggaatcgctgatgcaagtccagcgtccccgcacccgcttttttgaaaccaagaaggctttggcgttcaatgtggaaacggattacgatctgctttatttcgtgtgtttagggtatattccgaggtccgtatctgcatcgtgaaatatacgcaaaatattggcacgtgtccagcttaaacaacagtttagtagaaatgaatccgacggagaaatattcctcggtatatgtcgccggatatttgtttttgtacggtgcagatgatggcagcgaactgcacatcgaccgcgaggatattcgagctgcaattccgacacctgctcctttgcccataaacatagatcatatacggaactgtaccgtcggagccgttctggcactaacggacgacgaacacgggctgttctttttaggaaaaataaattgcccggtgatgatacgcacgctcgagacggccgctagtcaggaaatattcagcgaattcgataatctcaaaacagaggagagggtattgtatttgataacgaactatctaccatcggtgtcgttatcttccaaacgtcttgaacccggggaaaaggccgacaaaagttttctggcacacgtagctttgtgtttattggggaaacgaatcgggactatcgttacatacgatcttactccggaaaatgccattgaaccgttcaggaagctttcccctactaccaagacggccctactatccgaggggcaagaaacagagcggctcttaggcgataaggtctggcatcctagtaaagaggcgatgtcaaccgcgttgttgggcaccgctctgaacaatatgttattaagagatagatggcgcactatttccagccgaagacgcatggctggtatatccggccagaagtacttgcaggcgtcagccttgaccgcactggccgagtcgatgacgtccaataacgcatcaacgatccatccaatcggcgaaaccgcaaactcggacggcatacaaaaggatgatcgaattgaagtgtgcgccacttcgccgcaaacgaacaaaaccttagagtccagagcattttcgggagggagtgggttcgccgggactcatgcgatctctccaccgccccagatgagcgcacaatcgccaaccgagatgtctatgaatactaaatctcatttcccccccggcgacgatttcatttgggttcctatgaaaagctacaacgaactggtgtcgagacaggccacgcacgcaattaatgcccccgaagctgcagtggggagccaggcaccgtatagttcctctccgttaatgattccggcgcacttgggacagcatgctcacattgggggatatggacatgcctccaacccgcaatttgcatcgggggccataaattacatgggcgggtttccatatgctctgcctatccaccccgttccaaccggccaatcgtctttggaaaccaagctgtcggctctactggattgtatgacgagggagaaaaaatcagtcgatggggatcgcggacgtgacgacatgttctctggccaagaagaacgaggccggcgcgggcgcaagcgcccgtacaactgtgacaaatctcccgagcaggaaccttattatccaggcgaattccagcagtccgagcatcgtaacttaagatgcgaagacggcatcgaatacgggcgagacgcgactcaaacgaggcccgccctggcgggcctcgtgaacgctgttacgtctttgcagaaagaagttgaacggttaaacggaagggcgcaagcccattcgataccggccgtacagcatatgcaaggaatgggaaccggattccaggcccccgtatactacgcataccctcctctcccaataccacatgtattttcgcggccgccagaagacggccgcccaatttcttccggggagggaagggcctcgctaggtagcgccacgggcactcctccgtctggatcggtacctccgaacgcttctcaagaacgtgtcgatgcagctcctaaaagcgacaccgttcagtcgcaagatactgtgaacgccagtacgatcgccaatgtacatcgcgccgacgatgcaggcgcggatattttcattaaacaaatgatggcttaaatgatggcaggggatccgctatgtcgacgtataagtttatacattttgcgaccgcaatagcaaataaaagtaaaataatcgtatgcgcacgtgagaatttatttatcgagaaacagcatcgcgctaaacggcatcgtcctccgaatcagagtacacaggcgataatctatcgtagtgctggccactactttttagcctcagctttgttaggtgattagaaagaatagcagtggtgcctcttgtttttttgcgcaaatcattttcgtggcgttcctctgcggacaccaacgccatatattttatcatttctcgagccttctgtaatttttttttatcgattggtgccttttccgagtccggttcttctccgtgcaactcgcgcgttgcctgggactttagctcttccgtcgtcactggatatagggctttcatcgggttgcctctaagcttgtttacgtaccagtaagctagaaacgcagccacgagtcctgctataattatcaatcctaccgctaaagctccgaacgggttagacataaaagcggacactccagatacggtagccaccacggcaccggcggcacccacaacgaccttccctatggcctgaccgacttgccccataccgttgaacaattccgccaggccgttcataaaagcgtaatttgtatctacttctattactttatttatgtcataaaattttagttcgtgcaactggttgcggcgagccacctcggcatagtccaataccccgacatctcgcaactcctctttcgtgtagaccgacagaggaagaatttctctgtcttctaacagtgttaagttcaggtctacaaacgtgctggctgtctgtatatcagcaacctctaccatcttaacaaagttatagtcttcgaacagagcgtatgcggatccaaacaggaagtatctccgctggttagccgtacacggttctacggcctccagtgttgggagtagctcgttattttcgccgagctggccttgtatcctcccctggttctcgccatacgaaaacaagaccagcgggcggctgtagcacatattagtagacgtggcgaccctcatggaattctgcaatgttaccgattccgcgtcgatcccagtacaagtagacacggcggtcacatcccctaacattttagccgctacgcgtctccctaaggtagcgctcgcgatggcgctcgggttaattttcatcccttcctgccataaagccagttctttattttgtaattcgcaccaggccgtggcgattcggctgaacatgtcgttgatatgagtctgtatatggtcgtagagaaattggagcatggcgaattggacggacgaagtagatcttatcgtagcgccttcgttcagcgccagtttttccttcggcgcattacggagctctcgccgcaaacgggacaaggagacatttgttttattggaaagagcatgcttattatgtactaggtctagcagctcgtctgtcctgttgtccctcatcagttctcttagatacatgtgagccagagatttcgacataacgggctgatacgccacaagaaatccaccgagggccaaaaaatattggaccttcccgaccttgacgtggctgtcgttatatttttgcgcgaatatgcgcttgattgttgtttcagcgtcgcgctttacgcactgacctagcctgatacgatccggatcgaattcagtggtattgctgataaatgttgacgatagctcgcgggccatgaatctatacttgccgttaaccgttgcgcgcaacatttcagtaacatctttccatttaaccatcgagcatacacgagcggtctttgctgcccagtcccacccaaccgtaaaatgtggagtgacgaggaagttacgcttgacgggtatgctcgccttctgacgcttgctcagatccattgggaaatagccgtctatctgcctaaattgttctagcggatagcccatgggttcggcggcggcctcgggcggggcgacgccataaaacggggacatatttgcgatatctccgttcgccattgcaaaatacgagtatgggaatgcagccctggcatccatttcttccactatgcagttgacagacgtccccgtccgatatacccacggagacccccatacggtataagtgtcgttggtcgtatgccacgccttggactcgggggtgttgaattttgacggttgtagaagtacctgtttttctccggcgtcgccgtcgtatgcctcgacgtatacattgtttctcaggtatcgcgctttggaggaacatctccctttcgcgtcgattacatccgtaatttcttcgatggaaacgggagtcctatctgtaaacctgttggtgatttgtctgtacgtcgtcccggtccaggtcgtcgtttgtataacgttcttataataaagcgtgactttgaatttgtatgggtttatattctctttgaagagtatagcaattccttctccccattcggtggcctttagcggttcggggcattttcgcggcggttctaaccggaccacggtcgtaccgaccgccggtgggcagagaaaaaatgaggactcgtcttcagacagctgtacgctcgagactgcttcccgcgacgttacgttttgggccctcgcgactcggccgaagaagtagaaaaccacagatatgaaaagtggaacgcagatcccactgaaatggttcattacgggttgatcttaacgagtctcatcgatagtgtggaaaggcgcgccgcggtacgaaagatatcgcactggtcaagtgggggtgtggtcatggtttgttcgttccgcacgtatctgatccgcagccgcgggagccatgtactgcagaatggaatagagcagcgagaaaacatccgcatcaaggattacggtcacgttgtctgattccgcaccgaggaccgttatgagagggcattctgtttcatatgtgacgtatattccatcctcccatatgtattccacgttaacattgagcggcaagcaatctgcacgacgcaggtgcaattcaccgcagctgaacgcggaagaaaataaagttgtcgccaaaatcacctcttttatatatttccaagccattctatgggccgcggttatactatctatgccgtcgaagtcgtaaaaccctctgaatttactgacgatccagtcagacgaactgcaactatgaatcataaatcgcgctatttcctccttcaaatgcggcaatagaccaacgttctctacactgaaatatagcgctgtattcgaaggttgggcgaacctatgtacatcgtgattaaacatcgggccgtttaacaaccgaaaaaatttgtgagttaggctggggagcatcgcgggatctattctgtgcttaagtaatgacgtttgcatgaaacggtgggcgtcgaacgcatcagcggtgatgcgattatcgatgatattcgtacatcgtttcctaatggcttccaataacctattcctggagcggaacccattgaataatgtcgtgtatgagtctatcaatatttcaccgtatacgttaacccgcagcattttttccagctcctttctttgctctgtaatacatttatccaaacttgcgagggatcttttacttaggcgctctgcgtacattttgcgtctccgagcaacgtcagccgatgccgatcgtaccaactctaaccagtcgtagtgctcgcggacatcgggtaacggggtaaccccttcgcgaatccgtagatgctcggagttactaaaatcgtcctcgggcgcgccgtcgccgtcctggcataggggaccatttctcgtgctatgcgaagtcacttgttctaaagtagtcttcagcgcgtcttgcgccgcctcctccgggtacaataaacgttttagcagaggagtcgacatatgatgatcgtaacatgctcttatcagcgcttctatgatgtcgtctggcgctaccgccctaccccccagaagcaatctgtcggccgcattcatattctcgatttcttgtgcaaacacccgttcgaaatgatccatgcgccgcccgaataccgtcatttccacgacggatgttctcagatcgaaaagacgctctttgaatgctaaatcttcgaggttgtccgcaaacgagtcaatcgtgtttgctctcggttggttaggtttgcgttcggacgaggcaatccagaattgcagctcgctaatggcatacagattccccgatgccggcaaaaaaacgttatgcgcgtccaggacggcggttgccgcatcggcgacagacactgtatcgccgctacctccgggatccttgtctccccttgtcggtctaatgagcgaaagtgccgcttgtacaaccgaacgcttttcgtcggacagacaagcggcatgtgggatgtgcgctaccatgtcatctgggtggacgcggagaacgatctgcttagttacatgattacatatttttccgattatgcgcttatgtgccgagtctccactgtttgccgtcacgcatagttcttcaaaacaaacggagcatggttgtgacgggtcgcacaactccggcgaaacgaccgatcccgcgcccagagtttcgattagatatcgatccagggccaacataaagttttctgcggttcccgcttttacgattaggtgacagtaattgagttgcttcaatatgttttctacgtcgtgtaggaatttaatctcggtccgcaccgaaccgccgtaagtatccaattcgacgacttcgtgatacggacagtccccggatatggtcatcgacttaataaaaaagccgtgtacatctccggtgtctgtaaactcgcacagcgcacgcagcagcacttctccgtctagtcgagctctacgcagagctaaccacaaaccgtagctaaggggactaatattcctctcgagttgctccgtcagcccaggagccattaggttttccaaatagcgtaccatgagcacatttaatttcagcggcttgatcattcgcacacctactctcggatcgcatctcttcagcagctctacttgaaacaagtacgattgcaactgaccccatacagcgagcagtttctgactagcgaatatactgtctcgctcaacgtctagcgcttgtgcgtttccgtgaggcatatccaacgtctcggttcgcctcgtctacgctgaattggacctgagtcggagggagagcatgatgatatttataggggttagccgataacgccccatccggaataagacccacaaagcgatataagaaagagtatgctgtatatttcatatttccgtatacaggttgaaaagccgacaatgacgtagtatctatcttgataaggctatgcgagcaggccccatccgggatatgagctaggtagttcgatacaaaagtaaacgcgtttagacccaaacacagattttaaaagcccgcaacccacgtactgggacaacaatacacgcggttatagcatatccaccgatagtcctggagcccgcttttcgggaacgggctccaagtcaaaaacgtccgaacacggacgtttcaaagttggctctaatatggacgggccgtccgcgcgtctttccgtattctcatcaagagcatcgtaattaaacgtaggtccgtccagcgggagagccttcgacatatcgaccatctctttcgctaatatcgcggcagcatcgacactccaaccgccctcgcatccctctacctgcttgttaagttcatctatcaaagatgagatgtacgcatcgttagttatttccatccagtcatccagttccatttgccgtacacgatctccaaccattttcaacgcgatcatatatacggcggcatgaggcgctccgcactcctcagataaaaccgcccgggctctatccacgagcgtggtttccttcaagcccgaggaaaatccagtctgttccgatacaaagccgaccctaggacatgccatgacgaaacggtgggttctattaaaagacattatggagcagacgtttctcccacccattatgttgccccagttgccggattggaatacttttgtgctaccggccattccgtgatatttactgatgctgacggctatcacaacaaagggtttagaggccatgataggaccgacgagattagtagatgaaaaggcagcacaccatgcttccttatgatcacagatattttttagcagttgctgggcggctggtgccacatctgacccttgtgtgaggatatgttcgatccagggcaggaccatagccggatccctaggtcgcttggaggttgcaaccaaagccgaaatcgtgttgataaagaaatgcttatgtgaacagtacctcaggatggtattcgctagataaaattgagccagctccccgaagcatgtaggactgatgttaatgtaattcatatcggcgtagctattggtaaaccttttaatgaatgacgtgttctcctcggcatctttggagagtataccggccggcaactgattgcgttgtaagaggatccaaaaccagagagcattgggagtcgtgccattaggcatcttaacattcggaaaaagttgcgtgtgataccgtttgagcgcaaagccgagagggccattgagcacatgcatcgcttttgccggccgttgatacgcttctatcatgcccgccagccgggattttgtagcgtcggagacggtactggaaacgcctccgacgaacataactttattcttcactttaaattcccggaatatctcaaatgtaactttcactagatctccttccatgtgcaccgccagcggatcatgctgagatttgctaggatcgggaacggagatttgttgatcctctaaggtcaccgttatgtttttagatgtgatgaacccggcgttttgcaagtccagtacgcgccgcctgagtaccgcttggaactgagtcctaaaatttctagcctctacttgttgcccgtgcattatcatagagcactggcttaacgccatatcttgaacgacggcaattatcgtgcgcctggataaaaatgagagcacgggacatatgcctgacgaatacggctctattgccagcgaaagggtatgggttgcatcacctagcccttcgcgtatgttatattctctgatttctgtcaaatttcgcatcagctggccagcttcgctctcgattatattagccattgtcgatagagcacgcataaacgatttgccatcccggatgatggcatctgcgggtgtcatgtctgctgggtcctcgcatgtcagcaaaccttctttttctaacgctttcattactctttcgaccgtcagcttgtacgtgtcctgcattacactgcggctcgtctctccctccgatcgtttgagagtcgagaatggggcgtagcttcccagcgcgttcacgtcgcagtagttattcgtcatagatccaaagagccccatagccccacgcatctgatacccgaatttcggcaatcgatattctaagcgcttaattgtggtatgggcgcaataaatacgcgacgctttgtcgcacaaatcgcatggtacgtccgcgtccatggcagatgaaacaaatttcacggtatctaaatcgtgatggcaagcttgagatccgccgtcacacctctccaggtagaacaagaatcttgccagcaattgcggacaaaacccacacgccaaaattaggtaatctaacgagtattccgacgggctggccgatgtggctttggacaaatcttcgcccggaatcggcttgccgtctctatcgattaacgggtttgaggccaaatgcggcgcggctatttggaaaaaccgataaaacgaggctgcggtcgtacttgtgtcttttccgtctgcgctactcgcttctcccacctcggtcatgtatataaccgaattcgaactaaacaccattgccccgaccagtcctgccacgcgggccatatacgcagacagcgcttccactctatctgtatatccgatcggactgcaatagaggggccatttctttacatcgggtatagactcctcgtagaccgatgtcgcgattacgttttctatggacagagtagcgtcggatgccattagagaagccgtcctacgttcataccccccgccagatagctccatgccttcctttttccccgctttatactgcgatttcgaagcagattcgatgggagtgaatgcgttaaaagctgtatctgcgggtaacaatgttccctcgtgattttcgtcaaagcttaaatgggcggcacagcgcgcaatcgcgtctacattgcgaacgcgaaggcctacggccgcggtactgagcacataaccgtgtaatagacgacataaggaatcattatagaaagcctttggcataagagctccctcgcctagtgctctaggcttcgtactaaatggatcgctggcaacgcggttgaagtccgggaaaaccaagtgcaggggatataacggtattctacgaacatcgacgccattaatgctcacgactccagtaccaccgtaatgtaaatatgagttgcagaggtacacggcctctttaaataattcggtcactactaagtagagcatagtttcttgaggattcattccgagattatcgcatatttgctcgccggttgtttcgaacgacgtggctaccgggggcgaataggtgctgtagccgaatcttcctcgtgccaaatcacatgctttagtcagattcggagccttcgtgcacggttttatacattctccgccgtgaaacacaaacacgcacggatggtaatgcgtcggaacgagcttgagagtagttgatccgctacccagacccgttgtcttcgttcctgcaacagctgccacgttccacatgaaatccgcttcaactgtaagacctgaaacgagaggcaatatcgcatcctcgcagtcattgctcttggccgcgaagatcgagagatcttcagctggcatgctgctcgtgggtgcagcatatacatatcctatcggccccccggtgatcttaacgcttttccctacatccatggttaaggtgtcagcgtttatccggtagactgtacaacggaatggcaaggggcgatgtgccttccaaagctgcgaacgccggcttcgccaggagatggcactttgactttctcgtgccggatgttttaaagccagaggacctccaaaggatatgacgcaacacttcctaaagtgcgccacgaaacacgtcgcgcatattgtatgttttataagtcctcgacttcaaacttgccttctctgtaagccgatatgtcagtagatggggctagaacttttttcaacccgtacctcggtgcacgaaagaggggacgggatgaagatagtaccataccgccgctaagtagaccgcgggacggggagagataccttcggcaacatcgcaatgcgattacctatatagcgactatagacgaatttaaatatatcgcccccaaatgcttagacgcggcggaaataaagcagcggggcactcatatcggcaaattgaaacgctcgcctatactgtacaaaaacggagaggaacgtgagttcttgaatttcgaggctttgggggacgcgtggccacggagatgttttagctggaataacgtatcattcttacccacggaattcgacccgcgtttttctaggtttcatgtgtacgatatgattgaaacggtagagtttgcaaatggggcaacaggcagagataaaaaccgttttctggagctattgcggcctatgggcacgattattaccatgatgggaatgactgaatgcggcaggcgcgtggctgtgcatgtctacggcgtcaaaccatacttctatatgcgtaagatcgatgtagacaccgcctgcgggagtcgatccacccgcggactcgctgagcagatggcgagcgtggtacgctcgtctgtgaacgaaagcgcaagaaaacgattttacggctcaagcactgtgacggccgactgtttcgaagtggacgtggtacgtcgtaaggatatttatttctacgggacagattgcgaagagtattaccggattaggtgtcagagcggcaaattcgttgcgctcatatgtgataactttcacccctccataattaaatacgaaggcagtgtcgatacaattactcgaatggtgctggacaacgccggatttagtacatttggatggtattccctaaaaattgggaattgcggtgagaaagtacaagttcgagcgccccagcaccatgttacttcatgcgacatcgaaattaattgtacggtggacaatttgattggtcatccagaggacgatcactggcccgattacaagctcctatgctttgatatcgaatgcaaatccgggggagcgaacgaatgcgcatttccggtggccacgaacgaggaggatgtagtcattcagatctcgtgtctgatgtattcggttcgacaaaagcaattagaacatgcgctgttgtttgccctcggttcatgtgatcttcccgaaaccttccaagagacgtttcgtgatacctatggcgttttgcccgaagtcctcgaattcgacagtgaattcgaactgctgttggcgttcatgacttttgtcaagcagtacgccccggaattcgtaacggggtataatatagtcaatttcgattgggcgttcatagtgaataagttgaccaccgtttacggtattagattggacggatacggggttattaaccaaagagggacgttcaaagtatgggatgccggggcaaacgcatttcaaaaaaaagggaaatttaaggccaccggaataatcgctttagatatgtattgcatagccaccgagaagttgaagctgcaaagttacaagttagacgtggtggcggaagccgcgttgggggagcggaaaaaggagctgtcgtataaagaaataccaacgcactttgcggcaggtcccagccaacgtggaattataggagaatactgttttcaggattcgttgttggtagggaaattatttttcaaatacgttcctcatttggaactgtcagcgatagcaaaattagccgggatattgctatcgcgagcggtattcgatggccagcaaatacgcgtgtacacgtgcttactacggttggcgggctcgcgaaatttcattctgccgaataagccgcaggtgcgtgcgggaaccgagttcgaaaacagcatcgccagtacggatgaatttgaaggcgaaccttccccttcgaatccaaaggcatcctcatcatttcatggaaatggcggcagagtcgtcggttaccaaggagcgaaagtgttagatcccatttcgggattccacgtcgaccccgtggtagtctttgattttgccagcttgtatcctagcataattcaggcacataacctgtgtttcaccaccctaataaacgacgacagaaaactcgccgatctacgtccacgcgatgattatatggaaatcgacgtacaaggaaaatcgctgcattttgccaaaccccatattcgagaaagtttactgggtatcctattaaaggactggttggccatgagaaaagcgatccgagctaaaatccccgctagctctgatgatacagctgttcttttggataagcagcaggcagccatcaaagtggtctgcaattccgtgtacgggttttgcggtgtggcaaacgggctattaccttgcattgatgtggccgcgaccgtgaccacaattggtcgtgacatgttgcttacagtacgtgactacgttaaggttaagtggggaaccagagatgccctcctccgcgaatttcccgcgctgacgaattatatgttgggcgacgattactccgtgagcgtgatttacggtgataccgattcggtgttcattaagttcaaaggggtagcgatacagggcctcgtcgcaaatggagacgatatggcaaaacgcatatcgtccgatttatttcccaaacctatcaagttggagtgtgaaaagacattcgacaagctgttgcttataacgaaaaagaaatacatggggacgattcacggtgggaggatgttaatgaagggagtggacattgttcgaaagaataattgccgcttcattaacacatacgcaaaaaagttaagtgatttgctatttcaggacgatgcggtggcaaaagcagccgccctcgtcgcggaaaggccttcgtcattttgggcaacggctcccctaccagaaggcttgaagcccttcggggacatattggctgaggcatacggtcaaatgacggcaagcacgttgtccgacgtgggagatttcgtcatgtcggccgaactaagtcggccaccgcaggcctacgctaacaaaagaatagctcatctcaccgtgtatcacaaattggccatgcggtccgaacagttgcccatggtaaaagaccggatttcctatgtcatagctgccgcaacgccggaggtactgcgcgatgccgagcgggtagcagaagccagaggggaaaggaaattccgctttagcgaggtctctgtcccggaggttccagggacgtttagcaacagcgccaagacgcgggccgtccaaaaacccaaggtattgatctctgacatggcggaagacccgacatatctaatcgaaaacaatattcccctcaacacagattattatctatcacatctattaggaactctatgtgtaattttcaaggctttattcggcaatgacaccaaaacaacggatactgtattaaagcgatttattcccgaaacttatacagaggatcgcgcctacgcgacgcgagttgcgcgcgccgtctttgcggagatacgcagcggggccggtctaagttctagcgaggaggaagaaactcttcaaagactgaatagagctttccgtattctaacagaagttcgccgtcgatattaatgtcgcatagcttacagtacacgtcgtcggcgttgacggctgggacatcactcgaatctgtttgacgatcgtattcttttctaatgactaataaaaagttaccgcgccacacgtgagcgattatgctgtaattcttacaggccgtttttaaacaatcaatcaatttgtagtggaggtggagagctttcccggggaacacgacatacatcatgtattcaagggagcctgcttcctgatccaagtaaaacaacaccttcacatttttcattccagaatcgagtagcacatagtatgcgaaaaaaagttccgggattgccaaaatacgagaaagggcaatttcgctatctttcccccgctcctctccgcaccccattctgccgcccaaggccacgatagaagccatgaaattcctataatgataaatgttgtttatctgttggacatatgccaatatcaaagaggcacgatcgtttcgccccaatcgcgggtctccgctagccgtgcacgtagggcaacagccaccaactccgagataataccccattcccgacaaagacaaacagttatctgcgacagcttccgacatattgaacggcaacgagactggcgttgtcttgatgatcggcacagccaaatccttgactaccattagttcctccgatggggactcttcaacgaaatcgaagtaagcgcgatacaaatcgacatctggttttcgagacccgcgtttcgtaccgcatgccggcgcttgtagatctcgccattgccgccgcgaccgtcttgctatccctccgctacgccctacagatctgcgtcgtatgaaaatgcaaccggtcatgccgggaattacgatgtcacacgtaggtttgtagcgtgtgctcgagagatatcagggatatagagtgtctttgaagaaatgcgccagcgtctttgacgaacgcggataaagtagtcggccggggagggaaaacctgatatgtcttgaacgtgtacgccaaggcccaaaacccggcgcatacgcgaccttcgaaacggttatggcttgcgagccgagctttatggagtgccaattcttcccggctcgctaggtccgggtggtcgaacaatgaccgtggattggtctgcgctatccgcgcagcacacatcgggtcgcaaaagaagtgtttgtagattgcttccgttcccgtgcctttgagcagcgccacgaagtatccgtcatcttcaaaatcggcatttctctcctgcgtcccccacgcctccaacaccggttctatgctatggaaaatgccgatgttgttagctgaataggcaatgatatcgcgcttaaattgccgcattgcaagccagtacgtgcggattagtaggaagttgcacaataagcattccgcggacgttccccctttggttatcgcgtgctttaattgtgttaccattaagggtcctaactccaaatcaggttctgagtcatcttcgtaacagtgactatatgcccgagtcgcccctctagcaagatctattctgttgtctttccaaaacttgctgaccgtctccttcctaaatttcgctgccataagagcgagttcgctcgccccatctggtgcagatcccgtgcccgaaagcaataataggacgagattcgtataacccatagtagagtcctcgccgctcgaccgttccgtatactgagaccgattagtgcacggtgctagtgcaccaagatcgttctccccgtcaggcagtgctttgctcaaacgaagctgcaattcgcgctcgtaaatatcgtcgtccgacaatgcgcgtataatgcaactttccgtttgagaaaaattacattctacgcttctcgcgcagtccttccagcctgccaaagcgacggaaagcgaggtgggaattgagccgaccgtttgacccgtttgtgggactttccttttactttcgtgtccagctgccgtgtcgcattggccctcgtacgacgagtgacccatgtcggacaccgtcgtcaacatggcccgcgtagcgctttgggccaaatacgaatagttactgtacaacactttagcgtcacccgcgcacagcgaccgtcctcttttccccgccgaacggccttgatttgcacggggcacgataacctcgttatgccgtcttcccggtacccccccgtcagttcgaaaacaaccatgcagaaagaagtgtctctggatatcctcaaaagttaaatgctttctcccaaacgagcctaccaacgtgcaaccgtgatcgaccagaaaatgcttatccattatatacacgaattcgaacgctgctataaacattgttgtagcgcatggtggagaaccaagacatttggaacacaaaaatgcgtaatcggccatccatatagccgataatccgaatttgtgcttatatatatctaaaacacggcaaacgagacattgtctatctagagcaaaaacctcggctgccgtcccgataaacgtcgccagctcttgatgctcgattccgtcttcgcaatcttctgcgctttcgctaccactgcaactctgaccagcctgaagactgttggtcttaatagcgtgggcggagagtagcaattcgttaaagagcgtatcgttgtacgtcaatatttcaggatcgaacgctatgtaagggcattttaaggactcctcgacccatccttccgacgcggatgctcccggagatcgaataaacggtagttcgacagtacgatgggccatggccgctgagacaaacactcggcaagtagatacgcctcggttagccgacgcgatcccagacgtagagttgctgtcggacgatgtcgataaattagctgaacgctatatttgcgacgggatcgtatatcgcgtatggttcgaatacctaatacccgatgaattagatttgattttcccgacaaccgacgggaagtttaattatctatcattcactagaagacttgcttctgccatccgacatggtcgtgccggagctgggagtgcgacccctacgtcgtttatcagtgccgagcgtgtctgtgaccatggggccgttttgagagggcggagcgagagatttgcatccgtaattaataggttccttgacttgcatcaaattctgaaggattgttagaaactagcaagccgaacataattgctccgccgtatatctttttttcttttacgaaggcatacagcgaatgatgagcgcgcctcagagtaagccctgtcgtcgtgcaggactaatagcacggatcaggctcatcgtcggcggagatttaactatgggcaattccgatcccggactcgcggagtctttttccggtcgcgttccggcacgttgcgtatttcaattcagtggggcagacggcgtggagagcgcgtttcccgttgaatacgtaatgagaatgatgaacgattgggcggggggtgagtgcgatccctacattaaaatacagaataccggcgtctccgttctaatcgaagggtttttcgctcctccgacaaacgccgctagagcgccgctgtgcgccgacaaagtgaacgtcctgttaaacactaccgattctacgggcgtcgttttatctgatatcaaaaggtttaaaaaatcagtgggtgtggattgcaggcctttccaggcttgcctaaacgttcattgctttgtaaggctaccaaatgttcagctggccttcagattcgtcggcccgaccgatccggccagaacatcaaaactgctcgactcggccgtagcgtcttacaattcgaaagcgaaacagcggttcaaaaacagttcgagggctatcgataacgaatcgagaccctgcgcacttcatgagtgtgttccgatcccggtaagagatgaaacgcagaaactgactagccaatctgatataaggacccctaggcgcgtgctgaccatactcaagaaaatttcgagcggtgagtacgtaacgaccgtacgcgtctcgatccgcaaaattatactgtgcctggtcagtgtattcgtagttataaccgcctggtggtgctacccgctctaaaacctcgcgacgcggcgtcacgtttccagtcggaacaccgcaccacagagtcatcatcggcgccactacatcgcgcgagactgcaatgtctcgcacgccctctccccagctttcgcctgtttcacaagcgttcgatccctccgacttgagcacttacaagttggatgtgctggttaactaccccctctcggatttggtgcatcaccttaatgccataccgcgaaacctgcaagtttccgacaggcattccgacctgaacgcagctaaaatcaacgttttacgggctctttgtgtgggattttctgacgtgcggcgcaaaaatgatactcgcactttacaacgcacgcccatgttcgcaatcggcgacgccgcatcgcgcttgagaccgtccattggattgaaacggacattccccacgggcatattctcaacaactatcataaactctcccgcagacgatgatgcatagcttttgtgagtcgacatgctttaataaaaaattatccaaatcgaacgagtctacttccctatgtcagttatccggtcaggagcattttgattttaaatatctctatcgttaatgtatcgattctggctctcaattgttgtcgtgcgtgtgcgatttgcctggccatcttttcgcatgccctagtgagtgcgtaaagcgcgctgcgtcccacctgcctaaaatcgcgccttgtcaataatctatcggcagagattactcgggacgcgctcgattcgtccgtgctggagcgatcgctatcaggaacactagattgcgactcgccatccgtgttagaatccacggacgatagagactccagcgcaaacagatatcgctctgggtcgatattggagtcctgttgcttattttgccctgcttctgcttccgtgaccacgaaccctctgtacatgttgtgatggtcgtgctttgccgttgtcgccttgcatggcgaacgtcggcacgtattaatgggtttcgactgcgaactagacggctgcgcgggtctcgacagaatgtttcccagaaccgcactactcggcgacgaaggctccgctaatataacgtccgggggcgcaaatgcgaagtggtcgtacagtccgtgctgcgccggactcccgaccgccgcctgctttttgccaccaggtgccgtcgagatatcgacggagcggtcaaccggttccaggttaagatccgcggtaataacggctggcgacgctcgttgtaacaagggagacgagtcgcggcgcacggaagcgagtccccctaaagtatcgcatcttggccttgacgcattgttaggacgaacacgggcggcgcccttgtccgagatccgtccgattgaatcaatcctcgttccggcacgcgacggcttcagcgctcttatccctattcctccgtcttcgtcgtcgggaatcagggattttgtcgaagacgcgacaacaaatggtgttgaggtcgaatcggagtcagatcgatgtggaatgtttggagttccatgctttttcctatcatcgcgtaccgagttatccgaaataactacggcaggggacttttggtcgagagcgcagccgggtgcgttacacgcggctgccgtatcggtaaattttagcctcccacgatagacaggctttggcatatcgtgcgcccgttcgctgacatcgatatgttttacggggcgccccttctgcctctcctcgatcccgactgctgcgtaggtagattgctcgttatgtgtttttttagttacgacgagtttttgagtggctggagataacagggacgggctcaatgtttcattatttgggggggcgagcttatagtgaaaggcgagtttggaagaggcgccatcggaagcatcggtgctaaccgtagaaggacactcgacattctcgggaactacccggtcgctacgatcgttcaactctttatgaaacaaaaaacccgtttcagcattgtcgtagacgtccttctctgcagccatcccatcccacatgctctctctatcccgactaaagtcattccctggtaattcttcatcttccgacgccgttccaatagatagtacatcctcgacatcgccgtctcggctcttgttgtacacggggatcggatattgtctagattcgtcggaaaaaaaattagccgcgtcctgtcggtcgagcacggcgatgtcatcatatgacgcgcccgtttccacgcgaatgcccgcatctatgtatggcagttccgagagaacagcgtcatcgctggaagttagccgtattacggggatagggtcgaataccgtcttaggccatagaactttcacgggaaccattcccgtgtccactatcactaaacacggaggagcggaagaaaggggcttggaggctatgagatgggacaagtgttccagctgttggccgaggcatgcattttcgattggattgctgtcgtctgccaacaatttccccccccaggaagtcgtgtcggatgaaacggcggcaggttcgagaaagcagccctcggagccgcttctcgagtcgaaaagacggacacacagattcagtccagagccggaggaatacgcttctggacattctgcggcgatcacgatccgtgccccgaataatgtagctgcggctgccagatccatagcgtttacttttaagactccgctagggggtgtggacgtgacggtaaatgtcatcgccactcctgtgggttcatataaattgggaccgtctgaacctttcgggatagttttgtcggcgggacgtaacacggacgatgtggtcacgtctaaagtcgaagcagcgtccccgcgggctgtgacgacgtcatcgtagcttctacagctttgctctatctccgcgggtagaagcgaggaccacatcaccgccaatgcggttggcggaatgcacatacgagccagcactgttgtcgttgtcaaaagattcgacggcacgaccgcacgaattttggcaaggcccgtactcgtagccccacctacaccttcccagggtttaagggggtctgtttcggaaaggctgccttgtttccaatcagaataccgcaaagcaaaaagggatccgcctgacgggtcccacgctccgcccgttaaactcatcggtcggcaattcgagtccgacggggcatctttggatagctgcgtagataaacagttgataaacgccgtagtggacagcgactcattgatagcgccatagagcgtcttatccataaaatcgtactggctaataagatcgagctgggaaaaggtcaagacgtgccccggcatgcacgtcataatagcaaccatcacgtcggccaactccagccgaacgggtcgtccatttgcagctatttttttaagcccctttttgtcggcggcaggggcgacttgccccggaagaaaaaaaatatcagacaagctagcacccgttttacgcgtgagcgtaatggccattaatgcgcaataaatggacccgatcgcttttactgtgccatccgccagccaatcgtagttttgcgtacgtacatacttggtgaaggcgcggaaattatccgccgcggcttgaacgaaacccagcctcaaggccatgatgtcgcctagcatgcccgcggcaactaccatatctctagttgacataacttttgaagggatcgcgggcctcaggcttaggccggagggctcgcacaaacacgcggccattttttcaccaacagttcgatagcagacagaatatctcaggggcgcgtcggaggcgtctaaatatgtatggatgcctgggatatctatttcagaaaacgcctcctgcagcgtgacaacaactgatggtctgatccaagcagctactcggtgtttaagatatcgatccacgaaccccgcggccggtctgttgttcgcgtcagcattcaatcctgtatcagaggggaggagcgatggacacccggcaactcccggcaaaatggcggaatatgcagcatacagcgccaatctcagctttacaagccgcgagtatcgagttacgtgccgaacgtaccacttggggagccgtttagagagaatatcgaattgcgaggctattgtactgagatcgtttaagacaaaggttggcgggatctttgcacacagagtgtccatctgtttttgaatcgattccgtttctttgagggccgccagaaaagcatccatgactccggctctgtctctgtatttcgcatcgataagtccgatgattttagccggcagcctagcatactctgcgttatcgcgcaaagcgttgatcgtattggaagagactttagcgcgagcagcactatctcgggcggcggcaaacccctctgagctcttgtccatcctgtccttatcgtgcataaacgtggaccatgtgtcatcccaagcgacttcggcaagcgctagttcggattttaactcgtccaatcggctcgctaagtccgcgagagcatcgatccgctccgcgtatatagtcatcggaccgctttcgtcgatccgggaagttagctcgtgcgaatctatgacagatcgggcgtgttttagccactctaccgtttgggtatccaattctttagtttcttcgactttactcaaaagtattgccgcttgagtgactatgtcgttcgcagtttcagccttttcaatagctttcgctatatgcggaggcatcgcgaccagccgcagcaggttttttaaattggccaattgctccgccgtctctctgtctgcggcataagaaacttcggccaaactcttcagaataacttcagctctcgatttcgcgccctcaatagctgtcgttacccgcagctttattgaggagacggcttctatatcgcgttggagagtatgagcgctatactctgcataggctgtcccgttgaacgccgtaatgtcttccttttccaaatcgttggttattgtcagtatggcgttcgccgaaggaatcacgatagagaccccatattcaagagcgcgacgcgccccctcagggctatacattctagccagattctccaatgcctctctaatttctatatctaccctccccgctgcgtgaagagcctctaccctcatttgttcatgccgagctaaaaagcccgtaaattcctcatgcccgttacgataaaaatccacgtatttggccaacgttgggaccgctcttacgtctggttcaatttcgcccaataacgtgtaatagtccaagttcccgccgcgggcatccgcgtgccttaatatagcgagtactatcttgattaactgtagcaaggcgtcgcagctaactccgaaaagttttgtgtaataaggagccgccgctataaacgcgtctagccaggtcatatttttcaaaaatgctataggaggcagaattccatgaattctattcggggtggaaaacgggttgaacttcaatacagtttctatcgcatcgtgaatcgcacgaccatgcgacataacaattttctcggctctggctctgaaacggatagtgtcgtagccggccaccacggcccttttctccaaatcactcatctccatagcatcaaattcggatttcagctcggcattggatagtagggaatgaatcgaggaaacccaaacgtcttcgctatgcgatctctgggcacttatcagatttctctcgtaggttgtaacggccgcctccaattctacggtccgctgatttacaagccctaccgattttgccaggtcggcaattttacgttggatgtgggggtccgtaacatgcgcgtgactctcgagagctgcgatggctgtattggcgtctctcgcgctctgcagcgcgtgagctatttcagttctggcgctcattataacactggcgtcgctatcagcggctgctgttttgggatctgaagttttgaccttggttattgacgcgatcacgctattgagtgccgcgcgcactgcccgatgtagaccatctaaacggtccccgtgctgcgccacgcccgcggccacctcagcgtcggataacagcaccgttaagaacgaaaacgcgtcatcctggcctgcgggtagatcggccattattcccgtagagggagtgtctgcagtcgccctgtttacatcggatacggcgttctgcagcgccgtaacagccgccgtagttttttcgaccgacatcggttcgaggcgcgcagcggcgactgctgcagaaagcgtatcggcatgtttcccgaaaaaaaccgacgcggccggataacccccaattggacccaatattacgcgtatggccagagagaaaggaatgccgaggccagataactctgcggcagtgctcgtactggggtgtgacaaaattgtcctatactgagagaacaacagccacaaatccgttcgcaaagtcccaataacatcgggtggtgcgagagctagaaaggtctctagcggccccgtatctccagggatggattgcgttatggttttgactgtcgagtccaatgcgcgcaacccagcaaacctttgtagaggacgcagcatcagcttaatcgaagaatataaagttctgatctcctcgtaacgatattgaagtgccgcaattaaggtttcggcatccagccgcctacgggcgatagccgcgcggtcatccgaacttagcaaatttgcaaatttgtcgccccctaaagcatttgacaattttactaactcaaccacatccttcataacttcctccagtttttgaagatcggccgttgtctccaaatcagtgtatgacgcaactctagcttccaactcatgtaagcggtccaaatccgccagggctgtttcacggcgggcggcgttgttgttaacggcatcgacttctttgatcagtgtttcaaactcttgtcgactaatccacccgcccgcttgaacggctgccattgccgttttccataccgccagattttctggattttctaaattagagtcattttccagcagatccccgagcaatttagattccggtgcagttgttacgggcggcggggcctgcgcgccactacgcgccgctactagggcaataacatcatcgagcacagataatgatgcgaacagcctggccattttttcatgttgctcgacaacgaccattttaaatctagatgtgctagccacgttggctcgaagcgcattcgcgctatagagagcccccttcaagtaatattcgtgtagtgcgttgccgactgcatcaacggctgccctctcaatagcagtcaagcgctgtgtaacgacagatggggagactttagctatgctctcgtcgtcgcgcgatccagaagtacccccagatcctcccattataaatgcatcaaatgaggcgtgcatcaatcgaacgccggcgtcgagggcctccaattcagctagtatgagttccgccttcctcctggcaacagtttccctatcacgtatgaacctgcacagcgatgcgactctgtcggtcaagctctgttcggcatgcaaagacgtcttctctgagtatatctttcctggattactattaaacgcgcttactaacgatgtcgccatcctttcgtagattctatctgcatccgcagtgctcgcctctctctctatagagtccaaagttttgtgaagggcatctgtgagctcctccacttccagagccactaataccagcttgcttagggccaatttgcctatcttggaattttcagaaagtacagattctatgaggtctgcagattctccggctcgcgaaaccgccattcccgtagaatcaatgaacgcgctaaagtgggcgggcctcgtaaatgctttaaataatgatgccatctcggcttctacgacagatcctatttccgttgtggttcgagcgccgttttcgataacgtagttgaacaatctggtaaaagtatccagcccacatatatccagaagtccgtcatagtcacccgaccgtgacaagtggatggtcattcccatacttaaagctatagattgctctaaatcatcgatgttagcattgatgtcgctcagaatagagctagggacgtgttcgcttgtccatagcccgtctcgtagcgactcgtccccttcccccgctaccgtgtgaggattaaaaggtggccggtctcgcaacgattggccgtgcacgaagtgctcagcacgcgcctgagaacttataaactcattgaaggagacattgtccggccgggtagcttcttcttgaccaggtatattatgtgtcgtgctcgatccactatctgcttgttcagacaaacttatcgatggagccaccggattgtccgtataggtcaaacatcgtttagttttccgggacggttttctgctcgaagattgaccttggccatcgacggataagttctctgaacttgacggaggagtccatacagggcgcctcctcttatgtctctcaaaagactgtttgggcggggagctagatttcgtgtcagtttcaagccgaactacattttcccgcgttttgggcaaatcaggccttgttagcaccgacagatcatcgccgatgtccgggaatgcagtggtccacgcatttacgatggactcatgattggttatatcacatatggcatcaactggagcctcctcgggaggcaggacgtatgcgtcctcctccgcatagcccatttcccgcctaacatccacatcccctgcagcgacgggagaacgatcacttctggaatcgacagcgactttgatgtcctcgctacgtgacgtggaggttccaatgatgatcctagttgttgtaggctgtggcctgtaagggggatcgagattggccagcactactttaatgttctcttcctcgttaaccctgcctagatccaaaacgatgtccgctgtaccgtacagccgtgatacggctgatattatttcttcctttggcggtgtactggagatcatagatacaaagtaaacaaaggtcgcggaccactctggcgccgtcgagggatccgcataggacgtgagatattgataaaaataaccctcgcttactcgaacgatacacgcttggcctatgtggccatgaccgtgtggatcgaaaatgtagattccgttatcggatctgtacacccctattcctatgacgccgatgacgatcaggcaataaatatcacctcgtttctgcttccatactttttctatgaatgtccgcgcagatatttgggtttctaagatagtggaggtgttttcatctacgtagaagtccaattctccataggagctcgaaaacgcaacacacaagttgccgtcgggctcatttgataagatcctgtttggtaaatcgtgagggacgcaagtcgtataccttccatcgcgagaggtttctattgtccattcctttccctgcaataacagtctatctatggcctcggtcgacaataccgcatccaacccatacgcaaaaactacgcgcagaaacgccaatgacgaccgcaagcatgaaaccgatgaccccggactcaagtccggggcaaattgattcctgttgccaacggcaactagtgtaaagtcggtggcatcaaccaccattcttgcccattcatctaggattacctccgaatccatgtttgttcccgaacgcatggcgcggttttgcatgttcgagacggagctgtccctcgaattatccgatgtttccaagcgccgcgtcgagggactcggttgtaaccgcgtagatttcttggatgggcgtgtagtgctccctctactctcactagcagccatatagacgatggggcggaatggcgcgtcttttcagattgcgctttgtcattgagcgagttagacattaaaagttgattaactccaaaattgtgatcaatcagttgcggccgcgtaagtggcgtggctgcaacatccaagtcggcacgaacgaacgatacgccaggccgtaaaacgatagacgtgtgcgtcacgcattgcgatctctcgcctgcctttcgttattaaacaccgtatcgacaatgtcgaccaaaccgtctacagttactctcggttttatgaggaagtccttcgcaaaattggcaaggtccacatcatcgtgtgccaccgtatccaaatccaatgtatcaaaattgagttcgtcacgatgagttaaattgtgcctcgatgtcagttcgactactagggcggggctatcgtcggttactacgggcagacggcccagcagggtcgctacagctgcgtcgatttcgtcgttcgtgacacggtcttccatatcacgcggaacctcgatccgatcagctattttttgccatactactcccacattctctatagcactggccaagtcctgcgaacttctgtcacgaaacgtagaatttatttccgacaacgtttgccatttgtccagcagccacacgatatcgccggtcccgggcggcgtggaacacgatgtcaaggctctgacgtgcaggtccagcgaattctgcaggcgagccaatctggcatagtcggttccgagggtagaaaaatagcttgctgcctttacgctaaataaaattgcgcgctccattaaattatcgcatgtatgaacttgtttcccagtttcttctattaaagtccgcaacaccattgatttgagtcttacattcgccattacatcacccgaggagtcgtagaattccctgagagccgacagcacatcaacgattttccatgtgccaaaattggcacgcggctcgccacggcggtaaaccgttacagtacctcctgctgtaccagctgcgaatttacacgcaaagaaatgcttaaatatgtacgcaaatttaaccaactgcctggatcgctccgctaaatatgccgcacacttcaacgttctatccgctaagtaattgaattgaagtcctagggccgttccatgcatactaatcaaaagcaaactattcgatatctctggacgggggggcataatcggtctggtctctggcggtaccatctgcacggccgcatagaccacgtcgtacaattcgcccatcagcatttccagattatacgcatcgtccgtggtaggcttggccgtcagatctctagcaaacggagcgagtgaggaaattagagcattgagcttgtttctatgattcacgaaactgccaatgtacggcgcgccgtaatccctggcccaagtcaaaatttcgataacagtgtttatcgggcgttcagaaaagacagatgtcgtgatagccgacaatgcgtccacgcaaacggtagctagaatatatcttagaaaatggggagttgtgctttcaggtgtgatgggcatggattcaggatagcgaattgtcatggccagacgaatcatacggctctccaggtctgggtccactgcatttggtccagagatactctctaaatccgaatggtccacactagctagatgttccgacggttcacctccaattaactcttccggtggcacgattccccatatatgctcggctctggagtcgaaccatagcatgagtgactcctttgcaaattgtattgctcgattggcagtcccggccccgctctggcggattgcgctatccatttccgcggcgaggatcgctcgtgcagactttacatagtcctcgtggggatttggcggtatacatcgccctaatatctgagctatgattgcgctatctaacccaagtacttttatgaaatctgaatcggcgtccggaggaaggccattgtccatataattggttaagtaagtcatgccgggaccataactttccatgagtccgaaaacgatgtttccgatgacagctatgcatccgataacctgttgtacgtcgtcaaatgtgtcgagttcattaacagtaccacgagtttttcccaaatttgcctttagcgccgattcataaacccggcatgcctgtctcacaaaacctctttctataagcgcttccaataactgtctcggcgacgaactgtgttgtacagccccccatgcccgcctagccgattcggagagtttcgctttagcagcatcgagagcgcccccgccgtcatttaagtcgccatcggtaataagccggaccacggcagacatatggatcgctaaggcatcttctgttaatgcgtgatcagctaatataatgtctggtccgttccgcaacttttccgctaccatacccggctgaactgcatatacatacgggtctccgtatgctatggcggcagatgctctaacatcatatgctgttcttttcatattgtttgcctctacggccgagataagttcgcgcgagcccaatgcgctggcatcttctgcgaatagatcctttaactgagaaggatggggcgatcgcggacttttaaaatattgatcgacaagggccagcgtaaatagtattcgagtgagtggcgtaaaggccctatttgttgtacatcgagacataataacaaacggggtgatccacccgacggctatagaaattaatcgaattccttcctgaacaaacgggaaatcgtaaataagtttaaagcgcgtctgcgtcaaggaagctggtagttccaaagcattaggagcaggttgacgtccggataacaacccttcggaagtataatcaaacgcgtccgtggcgatctcttcaaaaattgtcagccactcacttattaggggccacaaaacactcggtccaaaaggacatgatctgcgcagaccgtttcgggtaagccacgcaatggcttcttctcccgtcatttcggccgccaatctacgcaacctacgagaatcgtctttccaggacattttatcccaccttacggaggtacgccacaagatgaatccgacaaaattttgggccagcattgccgcttctgggcttcctgtttgtttgtagacctcgagcacagccgcgaatgcatcgcgccacgtcgattccacttgctgaatactcattgtttctagagcctggaaaaatgatccgatagcagttcttgcttccgcagctgtagcatttccccacggttccagtggcgccgttccagccgataaagaccttagtgtatccagtaaagttttcaacgggaatctcgcttcgccctgggtttcagacatggcgcgccaataggtagggatggatctacgtatgtcaatggaggccgtataaagcttcaataataatacgttccctaaaatgctgtgctccgcaccgcagaaaaatatcgtgtgatccgcagttacaccataccgtactttatcatctccatgacgcatcgagatcccgtataggccggcccacgtaagaggcacacgcgctacataactttgttgcgtttaactacaccgccagtcctgtattgcagtatactaggtgacatacagcgatttttatgtgcagtagtgcacacgcagttgtcgcaaaacgggcttgcaaacgatcatcgccaatacaggatctctttataactggttgttgatagtggacgtcatgaaaaccacttttcgaacaagcgacgtgcaggcatccaacacgcagtcaaatgcctcggacaggctgcatgacatcttacggagcatcaataactcaatgcactccggcattgttcggcgcatcaacataggctatccgcatgcgggcaacaggcgcgggacgttgaccgccggattggaactgttgagcaatacgatcacaacgacccctcccggggcaaacatacaccgctccattgcaaattcggcaggcgaagctacggcaacgatcatacaatctttacgaacatattccggaagtggagatctgaacacgaatggtgataataacgtcctttcccgacagatcagcctgacagatttctgtttccccgatgcggagatgccaggactaattgtcttatctatgcgacatccactggatataaacagcgaagcattatacagcacacctgccggacgggacccacgggcattggagtcagcgtggtatgaattatctgaactggccgcggtatcggtaaacagattagacggaagtggtgtccggccgtccctattatcgctctcatttcttattgcttcccgcgcgggagactatgcggataaatgtggtgctgaggctgtaagagctcacgtgattagcaattacggccgccggcggatagaggacaggctcgacaggttcggaagctgccaagcagcaatgttgagatgtcacgtgttcccacaccgacatatgcaagtattagggggaatggtgtcgtggatcgcacagcgcgaaatcgccagtataaccgccgtggtcaagggctctcaagagagcgccaggacagaacagaccaacaatccaagatcgtcggtatacgttcccgcatgcgcctatctcgatttagataaagagattcacatgctccatgatgacagagcttcttcgctactatacctcgttttcgtttatgcacaacacctcggacgcgagagcatccgtgtatatctcatgcggagtcgtttaggggaatcggtgttcagagaaggcctcggttacctgtactccgggctaagagccggtaacgctattaacggtctggccggtataatagcgccacatggagtagacgcgaatacggaatttccattatcaaaagctttcgaggtacacaaacacgcctgtcgaaacaccggaatcggacctcgagactccgagaaagtggactggcgtttagatctccgaggccgccctacaaagaattcctgcatgtacgcagcatactgtcgcgtagggcacttgaacgagtattcgatgccggcgaagaagtctgaacgttgtggcgggtctgtggaggtccctgttgtatgggtgccgggagtagtgtgggatatcggagaatggaccgagtgttatcagtagagagttggctacaccgagatccggcatcataccttacgtgaactgcttacgtttggggatgtttttgcgtcggtgtttggggaggagtcaatcttataaaaagcctatttgtggtacgcttcggtctcgcgctcactgagcaacccgtattttatccagtctgaaatcagaatctaaaatgcagcgatccgatgaaaacgaatccctcgaagcgaatagaaatttggacaccgcctcgcgtaactgtactgatgtgcaggtagccttgataatggcaacgaaattgcatcgcatccagcagcaacttgcgagcatgggatatttatctggctacgattccgtgcccgatattactacacccgtgaaagttctgcgcgagcgcattacccatctagtaaatacattgaaacccgtttgccgtttcgatgagcgcgtgtactacgcctgcggggagctggtgcatttacggatcaaatcacaggaagctacttttgatgcgtggttgatgtcgaaaaaattaagcctgaaaggcgagatcgtagataacatacagcgccacagaggtcacgtagagacggatatgctgcgcttttacggagtaacctatccctggctgaaacgactgggtttacagtcggcgttgaaatacgaagaatatctgactgagttggaagacggcaaaaaagaatctctttgccagttttttgttcggctggccgcggcggcagcaaccgaagcgtcaaacaaaaaagctttcatgtcggctttgggtaccgaagtgtcgacctgggaaacggctttcacggctttttttttcgctctcgctcgtcagatatttgtcccatcgactccctgtatgctttttttggggcgcgaaggaacctcaaccgcgagctgttatctcatggaccccagaactataaatacacacgatacccttaaagcgatcgccgacgatatagttccccatctcctagcgagaggagggatagggatatcgttgcagcatttaaaccaaaaaacaggccttatgcctgtgatgaaagtattggattccttagtgatggccgcgaatgcgggggagcgtcgacccacgggggtatgcgtttatctcgaaccgtggcacgcggacatcatgtctgcattaaatatgcgcggcatgatggcgacggaagagtcccgtaggtgcgataacgtatttatcgccctttggacttgcgatttactgtttaagcgctacgagagacacgcaaacggggagaaaaatgtgacgtggaccttattcgattcccgcgcgtcgatattggccacgcttcacggatcggaattcgaaaaggagtataaccgtttagaagcggaaggtttaggcgtagctagcctccctgtaagggatttgatgttcgcaataatcaaaagtgcggcgtccaccggtagcccctttattctctttaaagacgcgtgcaacaagcactacattacagatactcaaggagacgccattgcaggctctaatctgtgtaccgaaatcattcaaaaaaccgacggaaatacaaacggggtgtgcagcttagtaagcgtcaacctcgcccgatgtgttttcgacgagaacggagagaaaaaatttgatttttccgcccttagacgcgccgtgcggctggctacggtgttcgttaactcgataatgtctagcagcgatgttccgactgcgaaatctcgttccggtaaagatcgacacagatccatgggcataggcgttcaggggcttcatacagctctgttgtcaatgggtctcgatttgagcgatgaacgcgtcaagcccctcaacaagcagatttttgaattgatgttgttagaggccatgacggtcagttgtgaattttgcgaaggcgggttgcccgccttcgccgacttctccaacagctattactcacgggggcgcctgcattttgatggctgggcaaacgtaggcttaagtatgcccgaagagtggaatgcgctgcgggagagaatacaggcgtccgggttatacaatgcccagttcgtagcgttgatgccgacagccgcatccgcacaagtaaccgaagtgagtgagagttttttgcccgtgttcagcaacatgtttaacaaagtgacgacggcgggggaactactgcggcccaataatcaattaatgggagagttgagggagatctatgcggataatgaggatcggcgattgaaagccatagcagcgttggagtgcgcgaactggtgcgtggagaccgctctgggaaataagcccgaatgctctcaattacttaaatacaaaacggcgttcgagtacgaccaatccctcctaatagatttgtgtgccgatagggcgccttttgtggatcaaagccagtcgatgactctgtttgtgacggaagcggctgacggaacgctgctggcgtctcacgtcatgaacctactcttacgcgcctataaagccggcctgaaaacaggaatgtattactgcaagatacgcaaggcgactaatgccggagtattcagcggtaacggcgaattgacctgctcgtcctgcatactataatctccaagcatcccggcattttgaccatggccacgcaagcacgcgggaacgaatttgtcagcggccaaaccgcacctctgcacaaaaacccgtgtcccgaaaacgcggcggccgtcctaaagatggaaggtatcgagatcgaaccttcgactagttccgctagagataattacaaagtgtcacggtacttctacgtccccgaatgcccagatatagggcacctccgagctttgagtattatgaaccgatggacggagaccgaatttgtcgtcgccgaggatctcggggacgtcgccaagcttagcgaagaagaaaaaaatttctaccgattcctctttacgtttctctctgctgcagacgatttggttaaccttaatatagacaatctgttaggtttattcgaacaaaaggatattcaccactattacttcgagcaggaatgtatagaagctgtccactctcgggcctatagcattattcagctgatgttattcgacaacgactcctcggcgcgcgcaaaatatgttcagtctgcgttagagtcccccgtcatccaatctaaattggaatggttagaccgacgtatactagagtgcacgtctataccagaaaaatatatccttatgattttaacagaaggcattttcttttcagcatccttcgcggctatcgcttatttgcgcacgaataacctctttgtcgttacatgccagattaacaacctgatcagcagagacgaagcgatacacgtagaggcgtcgtgctgcattttcaagaattatatcgctggcaacaagccatccaccgctcgcatccaagccttatttagcgaagccgtcgacttggaatgtgcatttctccgcgcagccgcaccacgcgactctcgcttattggatattggctcaatctgtagctatgttcgttacagcgccgacagattattgagaatgttggacgtgccaccgatttacggcgaacccagccccgctgccgactttccgctatctctaatgtccgcttcaaataatacaaatttcttcgaaagaagaagcaccgcgtactccgggagtgtatcgaacgatctttaattagcctgtgtgcaactgtactttctacccctacccacaagaattaataaatgaattcaaattatcgcttttcgcaccgtgtagtttgtgatgcatcccttccccagtaccttatcagcacggagtcgaaaggccgtacctccgggatacaccttagaaatgcggttgaaataactgaagcttcggcctcattgggtatactgcgaaacaccaattcttcaaccgctacatcgtcacgtatatcctgcattatggggaatcgttttaaaatactaattctgggcgttctgcgctcgggcattatagtcgcaatgacgtgctttatgaacttgtattcgagaacttcgcatctcgtttttggggggtgcaaagatcttaacaagctgtaattggacgcgagatccctgttcgcatcgggcatatcagccggtctctcgtaatgatggccgcccgtgatctcaggattgcaacaattcatcaacgacgaccggccacgctcgttatcgctcgctttaccgcagatagtgcccgaaccctgcttcaatgtccctagatctattatctcttgcatggatttcagtgtgtgttcgcaatggaggtctgtttgacaccgaacgaagttagacaaaaacgtgaaatagtccatttttaacgccgccaaaacatctctgcagtagatagtcggcggaaatattctagtaaggtcgatgattatatcacatcccatcaatagcatgtctgtatctgaagataacacatacgcaaccgttttggtgtgaaagaggttagcacagatatcgtccgcttccatcatggccacatcgacataagggtatcccatatagcgaatggtatccatgcagagcctatgtagaattttgggcgtatcagacttatcgctccatctgcgtggtcttttccgcttccgcgttcttttgttccgcgcttctccggtatccgcattctcgcattcgtcgcgcgaacgtacttgcagcctcccagaacctcctcccctcgcgatgcgagtagctgctagcgcctttgctccataaagcgttttcccatacttcgaaaacccccggtccgatacaaacaccggataatacgaccgttggtgtaacaaacgcagcagacagtataagcaccgcagcgtggcgaccgagttgtcgactccgtcgaccttaccagggtaaattttttccagcagtccatacataacattccataaatccacggcaatgggcgtcatagccccgccggatatcgaacccgaaatgtgacttctcactaatccgttcgcataggcgaagtgcatgcaaccgtacacgcccatggcaactttcggagtcgcagtgtaagagacacggggtaatacgaattttgaattttgggagtatctgtcaagtatattcaactcttgaataaccacgaccaggcgtagctatccaaatgccgaaacgttaagccgctccataaaaccttgattccactattcaattgtgcaatagttggattagggcaggtattcggctctatctgttcaccgtatacacgctataccgtcctttaaattagacaaggtgcgcgtctctaaacctataattcccggtagcggtataagcgacacttattacatgcctatccaccacgtgatgcaacccacacgattcacgttgaagacatgtgacatttgctgtaaatatacgcaggtaacaatgtgtgcggcgaattagacttacagccaatagtaagcgcgacataacactaaatgggcggcgcgacattcgagtgcctataggagaccgatatacgtaaccacgcgtggtgcgattgcgacccaggctccttcgatataagctttccccctcacatccggagccatccgttagattgactctgcctcagcctatacaacgcgccaaagaacagtgtgctacggacagaagtgacgccgacttgagttcacggcatcgagaccccagaaccggtctcggcgatggcgcgaataactatgagcgatgaacacatcatagacgatgcaggggccacttctaacgattcgcccaattcctggaaagtcgtcttggccggagagaaatttagaacggtatcggctgcagtacgcgcaatagtagattctgtgaagaatcccctaatcatattcagcgacgacggattaatgatacagggcacgatttgcggtcagcaaacattcgttcctatcgagtgcgccgcctttagtgaatttgaatggcgcgggtccgcggccatattcctggcgctaacagattcgaggcgtactttattagacgcgtttaaatgcgacaagaaaaaagcaatcgaggtctcctttacgttccgaggggaaccgccgtcgcgacatctaacccagacagtcacgtatgtaactgataacggatcgttctcgagtgctatcatcaagtatgaactgtggtgcgcctcagttttattcccgcaaaaaattcccgatgttacgttctcagtaaacaaacagcaattaaacaagattttggctatagccgccaagagacggcacgagcaactaacatttgcgttgaaagcagaaggggggttttatgccggaactgtgtgcgatgttataagtttcgatgtagacgggagcgcaatgactcagtatccgtataatgccacgactgcggtctcgtctgccctcgtcttagcatgcgggaagaaaagagccgcccgtaatgcacccgtgactgcatatgggagcggaaaacctttctgcctcgcactggaagacacgaccgcgttccgaaacgtcgtacagaaaattaaaaccggctcggcaggggcagatttgggattttatacggcgtgcaatccaccgatgctatgcgtgcgtccgcacgcgttcggcagcctgaccgcttttctattttgcaactcggattgcatgtctatatacgaattggaggaagcgagtgtagcggtcggcgcagtaacatcgaaacgcataaacgaatattttcccagagtatcgaccatcgattcccggaaaaggcgcccgtcttcggtcctctcggagggggatgggaaactccttaaacccgacggccaataggtctcgtgtccgcgcgcggaccacagtcatgacgcggggaggtcaaactgatataagatgtgataagactgcttagatttcattcgacctggttattcggacatacatggagcccgtcgacaacgcgtctccgttacctccgactggcgcgggacactgtcttcataggattgtttgcatcgaccctccatgtacagcaaccattggcagcgggaggagcggcaataggtgcataaaatgtattatggttacgacgggctccctgttatcgatggccgcacacttgaccgtcaccgtattttgcgtttccgtgattccgtgtatagatcgaaccgcagcctatccacgctgcactatgggcgccatcttcgcattcctattcttttttaacatgcggcttactgcacgatcatcggaaatagtgctgctcattggcagaccgacacaatttttatgcgctctgacagcatcaatcgccgacacggtcgccaaacatctagcggctacccataaggattacctgacgacattgcgagcaatagaagtaatgtctctgttgacttttgtcatgctcggagctctgatcgcatcttatcattacgtctgcatagcaacgtctggagacgtgacgtggaagaccgggtttttagttgtggcggcagggacgattgccggcatcacggctccgtatggagacatttctcctctagccggctttctttcggcgtatacggcgttagctattcacgtggtcagagacgccagtcggtctctaatgaacacgtgctactaccgtgcacgtcgggaaattactgtgaacggtgcatatcgcctcggtcgcgcgcgtctcccgcccagcacggacgccgaggcgacgcgcgaagaagacgtatccagttacgatacgctgggggggaatattcctacgataattctgagcctcatagcggtcatctcgattccagccatagccagctttcaaaagtacatgtcgaacgcaactaagcaccagtcaacattgactgacacgttacgcagtatatgcggtttcttggtgggtacaagtgtcgcgatattccttccgtcgcgctaccacgaggttctgttccgtccaattcttgtattactgttaatattcggggcaatggctactaccttagccggcttcggtttacttctcgggccgacattgttttccgcgacagccgcggttctgtgctgctacacttgtataaatgtacgcaacgcgaatagcggaataaagcaattggcggccgccgcagctggtaaatgcatattaggaactgccatctcgagcatgttggtttgcgtgttaatacaatattcctgatcgcggagcgattaatttttatatcatgtgctcatagcgttctttcgaactgcgaataaaactttcgtggctactaaaggggcctatcgtgggtttatgcgctgtcgaaaacatgaaagggccgatttaaagctaagttgcgcaggcagaggccactccatatacgctctcggagacgcggctcgcacgccagctgaaatattttccccatgcacgcgtcacgcgcgttgcgagctttggggtggacgagactcttatttgtcgttttattttcgggccgcgtcctaagcgctagcattaaccccgatctagctacacccccggtcattgctttcaacccgtcaagtattccggccgatgatgggcctttggccaaagttcctgcatccccgccggcaggggagaaagaggagagccacaagaatgcaagcgacgcgcgtaggatgcctagtatagtttgcgataaagaagaagttttcgttttcctgaacaagaccgggcgtttcgtgtgcactcttaagatcgcccctccctccgacaacgaatggtcgaactttgctctggaccttattttcaatccgatcgaataccatgctaatgagaagaacgtggaagcagcgcgtattgctggcctctatggggtgcccggatcagattacgcctacccgcgtccttctgaattaatctcttctattcggcgagacccccaagggaccttttggacaagcccatcggcacatggagacaagtacttcatatggctaaacaaaacgacgaatacgatgggcgtggaaattaggaacgtcgactacgcagacaacggttacatccaagttgccatgcgggatcctttcaatcggcctttactagataagcacgtgtacatccgcgtgtgtcaacgacccgcctcggtcgacgttctagccccccccgtcctcagtggcgataagtacaaggcttcatgcatcgttaggcatttttatccaccgggctccgtctatgtgttctggaggcaagatgggaatatcgttacaccacgtaaggacacggacggaagtttttggtggtttgaatcagcccggggagccaccctggtatctacgataacgctgggcaactcggccatcgaccctcctcccaagatttcatgtctggtagcctggaagcagggaaatatgatgagtactacgaacgccactgcaatcccgaccgtatatcatcatccccggatatccctggctttcaaagatgggtatgcaatatgtactacgcaatgtgtgccgttcggaattaccatacgatggttagtacacgatgaacccaaacctaatacaacttatgatactgtggttacaggtctttgcaggaccctcaagcggcatagaaatatcatcagccgaatattactccaagatgactggcagaaaacaaagtatacatgtcgtctcatcggctatcctttcgacgaagacaaatttcaagctttcgattacttcgacgcgacgccatcgacgagggggtcccccatggttctcgcgatagcggctgttgtgggactagctttgattttgggaatgggtacactcctgacggctctgtgtttctacgcctccgggaaaaaatacatattactttcgtccgtctagtttgcggtgacattgatctggctcattatatgccccgagctcttgtaacatcgcggacgcgatttccgtagtaggcacatctcaaatgcaaaagcggcatgtcaaccgtataggtacatccggccctgcttacagtcggtagggcatatatccaccggaaaacttcagctttagactcctcaggtgatgaggaatagtatgtaaccctctagcagtacggtatttctaaaaaaaggtagatccttttccacacggcacagactaaataacgtacactacacaggttctctcgaacttcgtttggaccggaattattccctcggcagcgcctaaaaagcaaacctctagagtagataagtgtcagtgaacctaggccttctttgttccacggctggaaagctaagggacgaggtacacgcgaccccagccacgcacgaacagagtttaacggaagcgtcgtttgcgggataaggttgtcggaccccgcgggtccgttgaaaagtggctgcgcgcctaccgacgaatacgtcggtaacaattttagaaatcgaatatgactgcgagtaccgtacaatcgcgaaatacggtctctatatagctactcggtccttaaatatgtaagtatgatgtcccctactcccgaagacgaccgcgacttggtcgcagtacgtgggctgctccggatgatggacgagaccacatctgagcgacacaaacgttcgcgttcaggatgcccccggttgttatgcggttgtacgatcgggatcgctcttactgtgttcgtcatcacagctacggtcgtgctagcttcgctgtttgcattctcttacatgtccctggagtccggtacatgtcctcacgaatggatcggtttaggctatagttgtatgcgcgcgatggggagcaacgctaccgagctagaagccctagatacgtgctcccgacataacagcaagcttgtcgactttactcatgcgaaaattctaatcgaagctatcgcgccgttcgcctccacggacgccaatagcagcaacgtcttccgactacgcgatagtagaacaacgtgcgtacgccccactgccgcaggaccggtggccgtcgactgcccgaggacctgtaccgccatatgccagcggccgcgcccattgagtatcgtcgcttcgataatcagggacgcccgtacttctcttcgtctagaacgtcgcgaatattacgaagtttatacggccattctctcaaatggcagcgtgaaataaacgcgagagaccgagcattagagtagcacttatttattctatcgcagagaaacaccgcgcgcgttcaaaaaaaacacaggcggggtacgataaatttacgcggccgcgctatgtttactttatacatcagaggtcatcgtcaacctgcgcaaaatttccgttaccgtaaccgtgccgccacgatgcttgcgcacggcttttgggcgtggaccggtcggtgcctccaaaaggcgttcggggggcgtttcggggaccgtactgggagatccgacagccacggcgttgcacatatctgccggaatcgccaatcccgtcgtagaagcacaaccattcctttcaatcgaaaaagtggcagggagggttgcggctcggtccgatgcgggcgaaggctccgcatctgtgcgggtcccatttgacgtagatgccgtagtcggtgtcggggagcggagataagttagcgagcactgagcgggaggcggggagtcttgagtgaagtgcatagtgaagatggactgtccattagaggcaggcgcttcactggtctcgcccccgtcctctacccacgcacgcttcgattgctggggcgagtcttgcaagcatctaacgactgagtcacctcccttagccgcgggttggtaggtgaccgtcgacttaactcgtgcgtgtttgaaccagagcgccaccgtggattccgtgtcagcccacgtgcacgagttcatggtcggaaatagctcccccaggaagcactggaaccgtttctgttgccggagagcacgtctcaatgttgagttagccatgccgccctgcagccataccgcatacccgttaaagaccatgttgaggatatattgacagcggtaattcaaaagaccaaccaacgccacaatagcgactacaggccgcgatacttcactttctgggctgcttcgccacgcgcagcacgtccacaaagcgcccatgtgaacaagaggggctaaaacggttccgataaaatggcataacatcgtagtgtcggcccagctttccgatggtagggaactcacggcttcggcaagggccaaaaatacggtatcaaagtcgctcggggcccgagggccgaagacgttagggcacgcgcgcagatctaacacgtccattagccacaccgcccacgtatacaacgtccttacataactcagcaatagttgcaagcgtatcgacgtatcggcactaggcgccgttacatcatcgggtctcatgtagtaggcgtatttttgaataagctctgtcccgtcccgaatctctcgccaacatctgagatacagtgcattatctttcgcgagttggaacggtttcttgaccaaggcgttacgattaatgatagggtaaaagagcaatgctgcttcacgtctagtcggatcgcaggtctcgggcgaaccggcacggcatccatcgcgtctcatctctaaataattcatgtaagaggcctgataacacctcttgaccgacgcacgagtcagcttcttttttttcatacggcgcgcaatgcgcgcgcggtagggcctcgtatactcttccgaggcatcccctaacgcgaggtagacgacgatacattccggaactttgttagaaggagcgtcgcgcaacagcgtttgtcgcaaagcagagagaaatcctgaggggagcacttctacgagcgcgtcttcttgagctcggatacccgaaagagatgtacccgttgtttccgatagctgacacgggtactcctggacgcgcgtcggcgaacctcgtgaccgggaatttaacgccaacgaatccgtctccggctcgggagaagttggcgtaaacaactccggcgacatgctagcgcaagcatatcggtccatcggaatctatacagattaggcgcagtacggaaaggccgacttttgggacgcgaagtggccagaagcatcgctttccttagcacaactattcttaaatgcgatgcttactcagggcggattgatagtcccgcccatacggcgcgtcaccacgatctgcacgccgctccgtgcgctttttttttaccggtccgtttttttgaagatcgcctccttcgcatcttctaacacatcctgcagcgaggctagcgtgccgagaaggttatacccgctcggaggcggtactagctttagagcttccaactctccattcttctcctctccacgaatcgctgtcgcaatgccgtcgggcgggtctcctcgctcaaattccaattctaaatactccatagcgtcgtcgcggtcggctatatattcatctacgctaacaggtcgatacaagcctttacatacgtagcacaggtggcggtatagcttaaacgtttccgaccaaacgtctacagcgaggtcgtggtacatggcggcgatcgtgaggtgcgcgacgccgatattcaaatgccctagcagacgttgcagaacaatggtagtggctaccacggttgcggttaaggtgtctcccgactcgatatctctctcattcgccgaggtgctgcgcgatacgaactcgttcataagctccgtaagcgcagatctagtagcgacataagccccgacgaaagtctcccctagcggcgcgcccccggtaccataagaagctgattccaatctccccaggcacattccttccgcataaagaacatcgaggctctccattgggagctttttatgaccacggcctagcagtcgcgcccacgcgcgaacacgattagctttgaaacggtgaagcattcgacccgacgaaacatacaggaactgcgcggcgatactagcagccacacatcccacagtaacgcacgacgatagcatttcaagttcttctttcgtcacagacaccgtgtcagacgacactctcgacaataaaaacacttctgcccgtagcatagcggcagcggcatagcgcactgcacttttacacttcgatcccaaaatgcaacggagttctggccagtacgccagagagccgtaggaagcacgtaaaattgcagcagcggggcccttcgccttacggatagcgccgccttcaaacattttagcgtcacccgtaggaacgcgtggcaaagacgacaataatttggcgcgaccgaatttggaaaagccccctttatgtatcctcaccgctagctccaaagccgaggtaattaagaaaataatagcgtctttctgattcagctcgccagacactacggcactcctcagggcatctatcccgaggcagagaataagcgcgtgtgcttgcttcgccgtccgtttccaggcgagagcgccttttggtggcgcggacgtatacatatcccccttggcatagtctgatctgctgtcagaatgccaaagtggaccgtccccgaaagtattgccccgggtatgtagtaatttgtcttctcgtatagcctcgactcgaggcacgggttccaacagccgccgcaacggaatgaacgtgccaaggctctcgataaacgtcggactcgtgccttcgaccttgatgctattgagatcgggttcggccgataaaggggaagggaccgtgtaagcagatacgacccgctcgtaaggccgtaaatcgtcatcatctcccgaaaagctgtcgcttcccagagattgactcttttctctagacgatgcacccgagcctttacttatccagttctgttttaagtcagacggcgcacgctccaagctgctgtcgcgattaaatgaggttcgatcctcatgaccgccggctctcggtcctcgcctgcgtgacgatccgcggcgtcgtccgcgcacgcgcccagaccgagccgcatgtgtgtattccccccctctagatgatcttcctctaaactggacccatcttctggatcgatggcgaccttcagagccattcgagcctatcgaagaccggccagaacccctagaataatgcgtgcgcacgctagcgtttcgatgtcgccgtctagatgacgacctccgacgtctagacctaggtctcgacctcgatgaggcgtctgtcatgtcgcgcgacgcatcccggcctgaacgatccgaagagcgtccctcccgatctctgcgatagtgcgtatgagcactagcgttgcgatgacgacgcctagacgaagaccttcgccgtttagaccgaggtttagatctcgacgatgcgtctatcgcatcacgcggtacatcccgtcccgtatgctccaaagggcgtctatcccgaaaagtatctcgaatgtagccaataaacccttgtccgttgcgacgactcgtagatccggcagagctcctatatccatcagtctctaggcgatcgtacgtatcgtcgtagttcgtctctgatggtcccacgtgtatgcttgccatgttatagggacttcgcgataatcggacacgcgttttagttccgcgcgttacataatctcggaccgaaccggttctctgtcgctgctcttgaccgacatccccatgacggtgtagagccagcattcgccttcccgtcacaactcaccggcaaagtacggcggccgtccatcgccgtctcattttatacggtgcctaatcgaacggcggaaccgtagctatatcgaccgcgttccattgagaagggggcgcgaggaacggtaacgaagtaaatataataaaatcatttattagctgtcgcttttacgtacaacattgttttaactacaaaatcgtaccgtcgcatcaagtattacatcaccgtttaccgttcgcggcttacattgtgcgagcagcagcgatatcctcggcaatcgcgggcccgggatgtgtagaatcccgcaacatcgctttcacgatagtcccatggccacacgacgggccggccttcccagcgcggccgctctctccccgcgctgatgatcgcggtcttggagggtgcatgagagagtacacttccagctttgatttgatgcactggaatagatacgcggatgccctaggcgcgtttgctaaaaatgcaggcggggctgtcaaaggcataccccgctcttccactaactcgcatcgcatcaccggcagtccgagttcggaccgtacgtaattttgtgttcttaattcggcggcggttaacgcacgcccttcaactatcacaacgccgtggttaaaaataaccggttgaaataaacactgaaagtgtcgtaattggtgccaatcgcaccgcaggtgtgcaaataagttttgccttttcctctgactggcttcgagtcgccgcgatacatctcttgtaaccgaaaggtataaatgcatatacagaagtcttgcgaaccttgccgcttcccggtaatacgccccggcgatagatcgccggggcgtctctgacctgccgacgcacatatcgcatcgcgagggttcgttcgctccctgcctaagataacatgccaaagcacgacaataaccgcaaagtagagtgacataggatttttctctagcttccaattccatcgaaaagaatttttgaatctccgtaacataaacaggcaagccgtcctttgttaatgggggccgcgggacttccatcccgcaatgttcgtttagatttatcgccgtatatgcccatttctcttcggacgccgcatctaggacttcgctaggagagacggacagtagggttgcatgttcgtataagtgcccattaatcggaaagcacgagaacaagtctacgtttagtttttccagccgagataacagggacgggccctctgtaaaatccagttcgtgcaagagcctgttgtacaagcggttcggaggattcggatttggggacggaagcgaaattttgatcgaaaatggagcactcaaagagaacgaggcagattgctccgcgcatctcgtttgagagcaaagagtttcgctaaagctttcaatgccgcggaggatgtccgaatccaaacagtccgtcattccgtttacgggcgcttcgatctcggcggataagtccgtactgtcgcggcgagcatctcgactccccggtcccattctccgcgtcgccatccatctgcttagtagcgcccgccccactaccgatactttatgtgacgctattcactctcgctactatagttaccacgggaacttgagtagtggcgacgtgaagtcgtcggagcgcgaccgggggtttttgagcgacgatctctcttatctaccggagtgctctcgtcaccgtcgcgttttccatattgggatctggacttagggtttcccatatccggcgacagtccggactcctccgataattttcgcgtacatgcctcagcttcatccaataggtttgccccttcttgaatcgtgatcttgattatagccctggcgaggaattcctcgagctccgcattggtcctcggggcgttccgacgccaaagggaaagcgctcccctatatgcatggtactgggccacagcagctacggctccgcagaatatacgctcgttatagacgagcgtgtttgatcgccaggtactagttgctgacgccggagtcgtactaaaggcaaatttccctttttctattgccctggctccgggtttggcacgaactttggaggacagcgactcccctctttgggtttccgatgaggaatcttttctttcgatctttacagatctgcgtctttgtaatgaatgagacgggggggagatccggtccggcgactcgttcttggacgaatctcgtcgagcgcgggtcgacgatatatgggcactattatccggtgacgtgcgcatagttgagcgacgtcgactcgacttacgtctatccgaatctcccattgtatctcgtattaggcagccgattacagacgcgacgggccgttacgtttcaccgtgttgcgtctccgacactgatcaagctgttcacggcaatgacattcttatacgggaacagtagcgcccacgcccacacgatcttaccagccgtcatcgaacatacttgccgtgaatagtcggaagcatgcatggtacgacccggccaagagggcggagattaccgccaccagacctagataaaaaaggaccgagaagccagaagaaaaggctatagacacgcctacggcggaacacgtagattcccagaaatttcctgccacggcgatcggccttcccgaatcgatcgaagtagctcgcgactccacgagggacgcaattacgcaaattaacactttacagaccacatgatggatgtcggacaaacccatccctgcggtaacgctttggaaaagatgtcctcgcacgcgtcgggggctccgtggcgcatgcagttctccgtcgatgaagcgatatatgcgaggaacccagaaggttggacctgttatatagaagaacgcgacccgcgctgtcttcgcgttatcaacgactgtgcgatctcgttgcccaaacgcgatgttaagcggaagtatgaaatatgtgcgttagatctaggtgtacgagtggcagttcctcggaattatgtcgttgtgctggcgaaattgacggacccggatccaacgtctcggggcgtacccgtaatccgcgttgccaatggactaatagattctggatacagggggaacgttcgagtggtacttttgtacgaagcagcttgcaccattcctaaaaacgggctggttatacgtctggcgctcgtgcagttggcctatccggatttcaacagtcgcgtgctttttgacctcgctgatatcacgccccacttggattgcgggcctaacttttcgatgtcgattgcaaccgctgctaaatcgcacagcgctcaggctcgaccgctattgccccctggcggcgagaaactatggccgggaaccgggtgtcgggcactcgtctgtttgtacagcgatcgcgtgtctcgggcaactcattataacactttagacagcaatgtcatatttgccgtaaggtacaatgattctacgaccgttatcggcttaaaagatgtcccgaagtatgtgcataaaacatttgtacggttttatacatccggtcaatttgcaacgttcgttcctttttacgagacatttaatacaaagcggcacgaagatgcggcttacgatatattcgctccgagcgacattgtattggaatcaatgtcttctgtaactatcgcgatacagcagcgatatgcatgtgcggataagtcaatggttccttggatcttcggacggtcgtccatgaatttgcgcgggttgattatttccccatctaggtggatgcccgattcgtggttaacgctgactttatgcaacttaacggaagcaaaagcgaccattaaacgcggagataggatcgcccagctgttgttagtcaatcaggaagccgctgcgttgcttccaacggaaggcggcacggctgcgctgttccctacagtaggtaaatgccgtcgtcccgcagcgtccgcggaagctaagtggagggaaacggcagcattcgatacggaatcgggcaggagcgagagagagtgtgccggcttcgggtcgagcgggcaataatgtatagttgcgcacgattacatacaaaacaataaacacgaacaccacgctgcgttctggacaatcagtttattcagttacacagtccggtaacatgccctcgttgactccacatgtcttagcccttctaccgcttcccttacttacatcacatgacgttgcacatgccgcttgctcggcttcagagtgcggcggcgaaggtagccctcccacccgaccgtaaatatctgctccactttcgtccccgcagttacgggggtcagtagcttccgatagctctaagttttccgtttcgggacacgcggccaacgcttcgagcgagcaatcatttggggaagattttaagcctaacgctctttccactagagcgatatcattcatagcagtctctgtagcagcagttatttgtatcgcgtgttctacgaaggcatccgttcgtcccgtgccgacagacatgtagatctgcaagagggcggcggcacacgtgtccaccattcgctgcgcatttttgcgatgggtctcgacgaccgcgtcgagcccaggggttccttgtcccgaaacatgacgagataggcaatcgagattacggagacacgcactgtacattctagccaacgactggccacgaaccagttttcgcactccgtcggcagacaatatcgccatttctaatgtgatgggcgtggggagcataagattgacggcttgtaccgcctccctgaaacgatgcataactctgtcggaggaagacgaggtagacagtgctgtgtattccggctgaatttttctagagcgccttcttaacccggcgtgcattgtggccaaatcttctattatgtccgatataccggaggatgccgaccctgggatcaaagttttgtttgccgttgatggttgcgccgtctcgttctcccttgcacttcttacgggtcaggtcccatctatcaatcccgtctacgttatcagccactgggatccgggcaatcgtttgttagatgtcctttgccaccgcgcagacgatcgcgactgcggaagaataccgaatgaacgaggagatttaaacgcggtctccgaccctctaaaagtagagttttgccttctcagtcaaatgacacgcggtttgggcggcgccgatttaaaattgcggacgcgagcgatattcgtgtgccggtttacttcgcattccgagattaactccatcgtggcttctatagcttccggagcgcctattcaaacagacttattaatagccaccctctccgaatatgacacatttcgcctacatgatgacttcaacatcgccctccacatctctctcgcctgtttatcgcaaaagcgccgcaatgggaaagagccggcaaaatcaccggatcgaaatctgctatcgattatggcgggaaccttttctggaggtcggcgcggtctagccgggctgtatttacaatacgagcaaaaagtcaccgcggcctaccgacgtgtatatggggggtcgacgacgacagcgttctggtacgtgtctaaatttggaccggaagaaaagagcctggtcttggcgctacgttattaccttttgcaagctcaggccgaacctactgggattgctacgggttacgatttacaggccataaaagatatctgcgacacgtacgctgtacccgtagaggccaatcctaccgggttttcgacggcagacttgacatcgtttgccagattatcgcgtttctgttgcgtgagcaattatgccaacggtcccgtagctagggcgtttcccctatacgtggaacacagaattgcagccgacgtgacagaagtggatgcattgaaagagtatatagaaagagaccggtccgggttaaagatttcggatttggaatttgtcaaatatatttacttggcttacttcgagtgctacaatcgtgctcaattaagacgtcatttgcgagacgtgaccgtgcgttgtcccgaagaagatgtctacaaacgctcgtctctggggaaacacgcagtcgataatttctttacgcatgtgagatccagactaaacgtgaacgatcacatagcatgtaacgtatctccggatcaagtggaaatgggaaacgttttgacccgagcattttgtagggccaggacctatccaccgagtaccatggaaagcgatgcgcgtttcaccgggatttgcgaaccctcgtcggtgattataaagcgtctggatgccctagaatcgacattacacaaatacggatggccgcgcgcacggtctgaaacagttaacatgatgtcagagtgcgcgaatttgcccatcgcttcatctgccgatagtcttaggccacccggcctgccgctagaacatccaggcactcattgccggggtggtccaatgatcgtaaagcgcctactagcgctagtatccgcagatgcacgtgtcggggacataggaccgacaaacatgctcaccggcattcgggaatcggccgtcaagggccctcttccgatttaccggataggcatgtccaaaggcaaacaagcgtttgccgtgatggtggccgattgttgggacaaaatcatcccgtctccgggaattgtgaaagcccatctctctaaactcggcagatccggtagagcccccgaagacgatgtgatcgcccgagatattttttttacatcagaacttgagcgagtcacgggccatgctgcggaactgccgtactttacctgcggccctgccgaagaacaacagtacataaatcgcaacgaagtgttcaatgacaatcttattgtggggaacataatcctggatgtcgatgtgcacttacgaacccccgtacccgtcaaacttttgcatgtggcaatgagaggttttaggaccggtgcgctcaaagcgttgtctctattacttccaaaagcaaaaatagatcacggctcgtacccgtgctacttttacaaaacctcgtgcaagaaatctcgagtcgtgcacgtaaaacattggatgtcgtctactaccgacttcgctctcgactgcgacggtcccgccgtcgaaagtgcagactgcgaactagaaatgggcttcgatgacccgttacttatggatcaaattgatgattccatcagtagatgtgagtcagatgcatcaagtttgccgtcggacgccgatctgccttgtaactgtcacgaaaaaataggattgcgggtctgcattccggtgccgcccccgtatctactcgtaggtagcagaacaatgagcggtctggctagggtactgcaacaatcggttctgttagaacgtagtttcgtagaacctatcggttcgtatctcaaaaactatgatatagttgatagcggagtatatggtcacggtcgcagcttgcggcttcctttttttggcaagatagacgagaccgggcttatatcaggccgcctgcttccgttttgcgtgataccggagcgctgcggtgacgcagaacagttcgttctgtctcatttacagcctaaaacctttcacttccacagtcccatgcccgaagaagatcacgcgtctgtagttctgaagggcctaggcggagagtatgccggattctttgaaaaaaaaatcacgatcaatagagatacgtttttcggaatcagattatccttagcggtagctctgaaagccaggggggttgacattaacgactctgcggcaatcgtatcattcgtaacggagcacattttagatgacataattcagtacatgcatgaccacatacccgatcacgctgcggaatataatcacgtttctgtttcgtgctgcgtcattagaccagattggatcctcttgcagctaatggccaataaaacattgggacgcgctcacgggtttacgtgcgtgaggtttaagcatacaagaacgactcgaatgagttcgcgttcgtatttgtctttaaacatcgacgcacatggtaggttgtgcgcgtgtgtgattcagcagtgttttgcggccaagtgtggaaacaataaactccgtactctttttacggtggatgtcgattcgaaatgccaggcagaacatcgatagccctttcgggaattatactctgcatctcgacatacgccatcgctttggtgatctacacgacgatgatagctaaacacggttctgggtgcatctatgccgtcctggtagacagcgatcatcgcgatgccaaaaattttacatgggagccatacaattctacactggtatacacgccgctggggaataaattaccattggacggaggatttggcggttttagcgatgtatgtaacacatatctgatcaacgcgacggatttattcggacgcgcgtctcacgcgtccgccaagtcgaaaatccgttcggtggtaggaacgcgcaattgcgcagcctacttttggaagacgcatatacaagccttgaccttttccctaagttcgtacattatgttttgcgtcattagagaatggagacgcatgtttggggtggtgcgatctgaaaacgacagaataccgccgacgacgtacacgaagaattatactgccagggtaatcgctaacggattgctaaaaacggtatatactagaatgtctgaatttatgtgcgagattactatatacaaaaattctatgtgcagaatatttacagacgaccctatctcgtttatcttacgtcaccctttggctgcgattctccttataaccgagcggctcataaggctcggcgcacagtgtctgtgtgtactaacggtatcgattttttttgtaccgtgtaaaatagttttatcgaaatggttcttgtctatcaccggagttttcttaggaatcgttatttgcaccgagatgggcctgctgatagacccgggaccggctgaaaaacctgtcatgtttgcagaagttgccccagcccccaaaacccagcagaacggcgtggctgtcccgttcggtgcacacgctgtatgttccaattgctgcgcctccataatctccagcatagtcatcaaagttctgtacgtgttattcatggttaccctcatcgttaccctcgtgcgatatgaacgagcgctccagattgccctgttcgggcgtgcgtacctaccctaaaacattagtggccaagcctcctatttgcatcgcgcggatgtgacacgctaaccgcgagaccttataaatggttccaatgagtcattcgcccctcgggtgtacgcggtattctacagcagcgtattagataaactacacgggtttgccgtcgcgcctcaaggaaaatgtcagtgggagctttctctcgtgattgggacgatataatgagtttgtcagactacgattttacagaggaagaatccttagatgaaagcggcgaactgaaagaattcaagaacacgtccgcgttgaatgctattgagacagcccgcgacgcaattgaaagatcagccaattcaaacccccccatcgaagaaccgtcgttcatctccaaatctcatgcaggcgagacctcggcctcgaaatatagaagcttgcccctcgacatcgaaaaggcagaacggtgtgatgacactcgaggctacaacgtgagttcgggaaaacgaatgcgtttggcagtttcggccactgttgacctgtgcgagtctgagatcgaacggcaatgtctgaatacggaaacgcgggaccgtgcacggtcccccaaacattttgcatcccattatgaaatcgccgccaaaatacacgatcttcccagatctacgggaaaaaggcaacggcatcgcacgttagattctcgctcacgacgccacttagcgggagagcatcggcggcggggagctcatgacgaggaaagcagacacttttccctcagaatgcgtgaccctcattcagcacccggcaagagcccgctgtcgaaaaggcgcagtcccgttaggctccgtaacctctctgtgcaggaggaacttaacgcgatgctacaacgagagaaactgaagctcgacatgatttcgagagagcgcaatttccgcacttctagcaaaaaccgctgggcctcagtactggcattctcctgtaccggaaaaagtggggcatacgggtctcagataacgtggcaatatttgcttcaagagggaccggagcttagaaagacgttcgaaaatagacctagaacctcattgctggcgtctgcggcgcgcgaagctgtgttgcggggcgaaaacttagttgcggcattggagagcgccgaggaaaccctggcatggctgaaattacactctgttctaaaactgcgtttaatgaaccatgaccctattttcaggacggcgggtgccgtcttagataatctcaagctgaaactcgcacccataatgatgtgtagaaatggtacagacaaacggtcgttaggagacatgctgagaagatccgccacggacgatatcgccgattcattgaccttatgcttaattttgctatcgcgtattcatcgcatgatgatgtatcgcgtgtcgggtagaaaagatagttccatgatagatcctcggggatacatgagagagtatactcctggtgaatgtatggcgggtatattgcattacgtagacgcgcatgcaaaaacgtgttccgacagagcgtgcaatttatatattagctgtacccttatgcctgtttacgtacacggcaggtactttcgatgcaattccgcgtttgatatgtaacctactacagacgggcaattttgtattcttcaatagctttatttgatatccattaaacttaaataaagacaccgatattcaattggacatgaacagcgtgcgttttattttacacttagcctgtgtgctttcgacaccgagtaggaaaacgaaggacctgaaattgcacgcacgaccgaaggaaataagccatcgcaatcgcatttgaaatccaagtaggcaaattcaggagaacctatcacttcattgaacaagttctcgagtattcttatgaatgataagcactggagcccgccagggcgatcgcagacacaactaattaacatgccgtgagtgctgaagttctctctcatggcagattcgcataagtaaatagtcttccttcgagttcctatctccgtgaatctgcgggggttcatcagaagcgcaggtttgatttccgacgtgtgattagaatgaaattgtcgaaagacagtctttagagtcattggcatgtctgtcagtactatggacacttccttgcggcagcgatcggtaaggaaccacagtagttccttaggtagtatgtttctacctaggaaccacggtgttcccacggccaaaaaccaagcgtggtcaaacgatccggtgctcggagaagaacgctgcgtatccgctacccaaagcagtatcctttcgcagatagacgacgttgccgtgaccattctccctttccaacctcccgtcagtacactgtttattgggcccccggcgtgcgtgaggagtaccggtctagcgactattccataaacgttagtcggtgagagttctctcggggtgagccacattgggaagcccgtctgggttggagcgtccgatgtagagtcgtaattggcgcagcgctgaccctgcggtctacaatgcatggtcatgctagacgggacaactagtcgcccggtgcatttttcattacggccatcccttacgtccacgtaccacgtgccgtgagtgtgtaggtaacacgtagtgggcgtggaaaaacttatataacacccggcagaaaccacgtgcgcccagcggtggcagatcctcagttctacagtgtccaatggcggaaagtacagctgaaccgtcagcttcaccggtacgaattccgtacgtttggcaagtgatcgctccgttagcaattgacgtgccgtccgcctctactcaactagctacgggcgaacatgtgtcatgtgccgcatccgttattcctcgttcgtacgtcatacgggcagcgtgtaaatcgtcgacgactttccacgcgttcttctttggattggcgacggatccgtctgagaacatgtcccaatgcggtgcctcgtatatcgcgtatagaatgaacaagaagttacggactggtcgattgacaggcgaccaatgcgagtcgcctttttctcatgcgacgatcatcgactcactggatgaaaactacagcatggctatagagggactgtgttttcattgccactgcgaaaataagttttcgctcgagtgttggagatcggcttttagcgctgccgaaaaaatcgcatcgcagtgcagagctattcgcgagtacggacactgaataaaaacgaatcatgatttgatctaccatttcagcatttattggtttatacattctcgggttcgtatgtatacaaaatcttatggcaacccgcgataacaattcatttacgcataccaattgcgagagctaggggcgcaccctcaggttcgcctacgccggtatagcgttgagatctaatacgggagtagtgattttgcaggaatgtaagtggtagtaacacctaaagaaaaccacatactaacgctctactgttcactcgtatctacgtgcagtgaggttcccgcatatgtttgcgcgtcatcaatcgctctcgccagtatcgccacaatgcgtttttcgcgcgcgggtattgggacgcagtgtaagtggaatagcattccgcaggcaaaaaagttgtttgtcatgcaagcatccatcaagtagcaatcacatagtgggaccagacgcctcaaagcgacgtagtggggggaaccctcttcccattgcaaccactttcgaaatctgtaggtatatgctgccagccagcgccttgttctgacggttattaccctgaaccccttaaatgggaagaagaatccaaggtaccaatcgttggcgactggcccgtgcggacaacgggttaaggatgtgacaaactgtgtttgcgtgggtacgtttacgatgtatttcgaatcccgcacgacgcattcctcccagtgagatagtagtatcccataattcatgcatctgactaccttgggggtgagacacgctgtaatatgaggcgtcgcttgtaaaacgcacctgtatggaaccgttccgagttcggggattgattctatgatagcaagtctacttattccggaaaccgccatgacatcgcacaaaggaagcagttggttaattgcatgaatcagaatgtttgtttccagcacggcacctccaaaggaaaataatgtttcgatgcacgttcgtgccccgttctctgtattacagcttactagcgcaaggctgaggacaaaaacgagttcgggctttgtatgttcgagcggaacaccaatgcgacataccgtatcgcttaagtttttcataaaagtggatcttgcacgtttgccagatctgctccaatcggccgaaaaaaatttgcgcacaatcggatgcatgtctgtgcctacaaataccatgaaacataattcttgtgctggacccccatccccgctatctatatctacattgtctgacatgtgttgtgccgacaacaaacggtgtcttgtatccccatcaatccagcgctttctgaggtttacgggctttaggatggacacatcaccgcatttcggcacgcataacgcgggcatgtctgaacgggcaacgattctctctgtgagcagatcgagacggccgtgacgcacaccacgtgccggtacattaggcacgactgtagcaaaaggatggtagcgatggagccagcctaccgacagtcccgcaaaaaatcttatcggcggaatgtctcttttaaggggtagtgtgttacgaaccgatgaattcaatttctctgtccaaccacttatcgcttccgcaacagaaaaatcgtttctaagttgcgaatatgtttctaccacccacttgagatcgctgcgaagggcttccgacatttttttagcgtattcctcatctccatcacaatcacagtcgtgtctttcatttgcaagtgtgggcgcgcagatgtctacgcgacgacttaaccgagacactgtttctctagtgtaccggtaacatggactggcgcccgctctgaccgttagcatgcgtttggatgcaaccgaggttagataaacgtctggagaactgcccaattctttgctttcactggcacatatccaaccgtatgtatcctctgtctgtcctgccgcctcaaagttaccggggagaggtccgggactcgctagacagaagtcgatttgggaaaattctgtgtcattgttgtagggactgtgcggcctatctaccatagttgcagaatcgtgcattagaatttcagcgagcatggaatcgatacgttcgtcggcacccgcatatacggcacctattcctattcgcgtacaagagtcatcttctacatcaagcttccagaacgttgtcaggtattcgccataggctgcaaagtctgcatctgtggttcttcttacaaattcaatctccgggttccaacgtccacgtcccatacataggttgcgcaacgtgatcgagtacgccaacgtattgaaatcatttatgctagatgcttcgctattatcttcgaacaaaattatcgtatacaatttcgattgatgcatcgatcgaaggactgacaaatctgtcgcatatgtctcctcggggagaggtgtgacggtgataggctcgtccctacgttcgaaccggataaggcctactgtagcggtggtttcagtagtcctgatgcatcgtaaaattgtggcctcggttctaattttcccgagtaaggcccacggaggtccgcaattactattacacagggcctggattacggaggaagtgccagttggtgcacaccgaaactctggaaaccattccttggacggaataggagggtggaatttttgtcgtttagtccactccatctgttcgtacatggaaaatcgtgttaattcctgatcgtcgaaatgtgctaatggagctatagtgctgcgttcggctggtgcggaacctatagacacgacatattttggttgcacgtgcagttctctgagctgattaggaaataatactgcgtttgatgatagcaaagacctttcgggatcgagctccggagtgcagtgcgaagcgtgaacaattctacttttcttccgagacggtgtgaagcaaaacatcttgacgatgctacgttctatggcattctgcaacaataaagtatcaaattattttgacattatcatctatagtatgagcggtgtgttatataagaggacgaaacacttgtgaagtagacacgttttattcaggaactcacattttcactactacgctgttgtgagcagagagataagcgcggcggaaaaaacagtcacaaatactactgttaatataatgatcgcagccgcatcctgtcgggcattaaacaaccaatcctcttcatcattagtttccgaagagctagtctcataaggcggcggaggagagtcgtaggtaggaggtggtccatttgaggcttcatacggaggcaaatatgcagcgtcgcattgaccgtcccccagttgtaattcgaaatgttcatataccgattccccgggagcgtctaaaaatggttgctcctcatgtaacgcttgcgcttcgctcgtcagaccgcggtctagctctgcgctcgtaagttcggtttgcggtcggtcgctatccattttccctcgcccgcagtaactgtgtcgatggttcactactctcgaaggagttaaattgcctactttctcctcgaatctcgaatgtggctatgcagcatcagggtcattagcgtcagtattttcctctttggagtctatggctctaccccaaatacctcccgcgattgctcctgtgcataaggccataaacaggccggccctctgccaacccgttgaatccaccttcactgctctgccaattagtattcctgcaaaaaatgccatgcatgatcccattactaatgatcttgcggaccgaataagcgtgattaccattaaggagcgcattgtagcattctcagattccacagataaaacagtacgaggtactgtaggagcaaggcgctgacctacgaggttttgttgcacctttcccgctcctttttctgctatcatcagtaagttaatggactgcacgatttcgctttcggcccggaggaggcggcgggcatcttgtaccgcgcgctcggcgcgccggagcaggcgcgcgtgcgcctcgtccgcgtccgcgcccgcgtccgcgcccgggtcgtcgcccgggtcgtcgcccgggtcggcgcccgggtcgtcgcccgcgcccgcgcccgcgtcgtcgcccgggtcgtcgcccgggtcgtcgcccgggtccgcgcccggtccgcgccctccggcgtcgttctctccggcgtccgggtcgccccctccgtccccggctccgctctcgcgctccgcatccctctcggcgtccggaggggcgcgcggatcagcggtcgggtcgcgatcgcgtccgtcggatcggcgccttttcccccgccgcatcgcgttccgccgggccggtcggacgggagaagaagggggagggggggaaggaggagaggggggagggagggtagccggccggcctgcagttcgggaagagcgggggaggcgccgtccgaggccgccggggaggaggttgtggggggcgggaggatgtgtgggggaagggaagggggagacggccgaaacctacgcgttcgccgcggcgtccgatccgggatcgctcccgacggggctctcgttcggcgatcgcttatcctctgccgccaccttgcgtccgttcgcgggaagcgccggaccggcgctctaagcggagatccggcgcctccgcttcttatgaccgggccggtcgtgagggcgtaacgatcacgtgatgcaatgcaaacgagcggggcgaacgcgtcagcgttcgcaccgcgaaccaatataagattatatatataatatattattggcgcaaggtgcgaacgcccgtccgggccaatcgggaagcgggatcctatgccacgtgttcgtgtccggccgcggcccgcgccgggggctagaaacgccgcccccctcccacgggggcggattcggggacctccggcctacaaatacgcgagcggaggtccggcggggaccgtcgttccgctggccggcccgccgtccgaaagcgcgggaccgcggtaataaagcgcccgccgtcgcggatcggattttctggtcgttcttttaccgccgggcgaaccgcgcggcgaacgaacccgtcccgttgggatcgcaggcggccgggaagcgatcgcgcgccgtcccgagaacgtcgtctacggctcgcgttcgcgggggtcgccgacgggtggaagggggatgggtaccgagggcatcgaactggccgagctcggcatctccgccttcgggccgcgaccctcgcggcgtccggaaccgtcggacgtcgagggaggacgccccatcgttctcgtccgcggatcgtcccgatccctcgcacgagaacgagatccgaccccgcgtcggcgacgcggccgaacgccgctcgcggaacacggtcgcgggtcgccccccgactttccccccggccccgcacccgcggcgaggtcggaacctcgggaatcgattgaaaacgggccggtcgagataggaccgctctctcgttcggaagcggagcaataaagccgttcggcgtgagctcgggatgagtctcggacgcgcgtcggtccgtttctgcccttgcggcgctctacgaaagaacccgatgaggccgcgttctgttcgggagcggtcccgagctgtagggatcggctcagtagtaactcgtctcgggtttcgatcgagttctagcgaaccccgaaaggggggtacgaggaagcttgcggcctgccgcaaaaagactccgaggagaatagcttatccgcgatacgccgccccctcaaccgttcagcactcacttcggcgtcagttccgaagtgactttgtctggccggctcggcgcgagccggcctcggagagaacgcgtacatagcgatcgtgggctgggcaacgagataggagtagagggatggggaaaaagtgaagtcccgcgctggctctggacgaggcggaacgaaatgggggaggggacggcctctcgaacgagagcgggggtggggcatggtcggtggaggggtgtgggaaacgccgcgacgccgcggcccgtccatgtggtaatgcggggaatagagttccctgacggggaggagttgtcagctcaccggtcccgtgatcaacgcatatgccacatatatgcaaccccgcgaccctctcctcacgaacagggtagagggtctcgctttgttgcacacacaagcacactcacttttgcggcgacaatgaaaatcgtgagcccagaccaattgcccctatatgtgttaacggcctccgacggaacaacggagttcagtattcgagattggtcgctatgggatcgggatccggaatcccgtgcaggtacgcaccgcgggctccgtcaaacggaacgctctcttttggagcgatgtcgtttgggtccgggcccgagtagggttcggccggctatttccctcccccccccccccccaagcccgtgcgggaccgaggttgagtgggaaggtctcgcctgccggatcgggggggaggggaaaagacgtttgcgttatccggaatcgagccggaccgttttacgtttcagagttcgaacacgctctcacgagctgcagccaccggctcaagccctcagaccgcgtccgcgccccgggccagcctagcgtcgcaaacgtctggaagagtctgtggagtttggtttcgagggccgtgcggggaaacgcagagggctcctacggacgaccggaggagggagacgccgaaactgccgtgtaaacgaatgcttagcggagccgcgcccgggacgcgtcgtttcttgcgaaacggggtggatcgctcgcccgctcttagccctcgcgtacagtgcgtcgatcgttaaggtgtacgtgcgtgtacgagaccgcgtgcgagcggtctcgtcgtagtgcgtatgaacgtgtttattaaaaagtctttctcgcttcggtcccgtttcggtgtctggcgatggcgcgggcgggggagtccgtcgcgtaagtcggggaacgtactttgtcctctcctctcccccgaggcgggatgtgcgagggggggggcgacgggcgaccgggaatgcgtgcgattagtgttgtggagaacgtaccgcgccgaggcccgcggtgcgcgcgaagggttagttgggggaggggcacgcgcatcataagtcgctcgcggatcgtccaggtgtttgtgcgggggatacagtttcgcgacggggaggagccgttagctcaccggccccgcgggagacgcagatgcgatataaacagccccgcggtccacctccttgttcgcgacctgctacttagcctcgcttcgttcccacgtataagcaccactgacttacgcggcgaccgtggaagtcgcgagttccgaccagtgtcgcgtatatgtgttaacggcccccgtcggaaccgaattccacattcgagatgaagtgctacggaatcaggaatcccgtcccggccgcgcgcacacccacacacacccccacacacacccccacacacccccacacacaccgcggctacagagcggctgtcgtagtacgtataggcgcgagcgcgaacacttgcacggactctcgtcgtagcacgttcaaatcggtttattaaagccctcatgctcagactccgtgtcgatggcgggggggggggggtggtgagtgacacgaacttactttcctgcgacgctcccgagaggaggtgtgcaccgggccgttttctccgagactgaaaagagaaagaaaagctccgccgttcgcccggccgagcgcccggacgcaccggtgtccgtacggccttcggacgcttagagagcgcgggcgtttcgcgccgctgcggcgtttaggcgcgcagcggcgcgtttgcaaaaaaaaagaatgtacggagagacccgcccgccagcctctccggcccggagcggaaacgccgcgttatctctacgcccccgacccgcacatccgaatgcgcggtcggatcgcgaggttaactccctgcccgcgcccgcgctccgcgctccccctgcgttgtttaccggttcgcgatcgcgatcgcggaagtcgcagggccgacttccttgtttacattgaatacgtcgacggaagcgcaactgcgtatgtccgccgcgcagacgcagaagcgccggggccgaatccgggaagaagagtaatacggggcttctccagcgcgtaagtaccggcgttccgggcggtcggcgagtcggcggagaaaaggtggatcgcgagcgcgatccgaatccgcgggccgaggggaaattcttcctatcccctgtgcgttgagcgccccgtgccgtgccgcctttttccgtttccggtcggactcggagccttcccgccgcacggttcggactcccccccccccccgcaacggttttattttcccgcgttcgaccccggcgtgatgtccgcttttctgttaaaccgtgcgttcgtcttatagggaagccatcttaattctgacatgcgcgaatgcgtctttcccccttccaaggcctaaccccccccgcgctttctcgtttccgccgtgggccatttatcttcccccccgcgtaaacaattatccctcccccgcgcgtcctacttttcttctgagacctatcgcctttggcgattctagtcagattgccttttatagtcaagtttcgagcagatcctaagcaagcatgccctgtaccccaccccccttctaaataaatttccgatccctggaggtttccggagtatttgtcccaggagcggggtcctatgcagtaatcgtaggtctttcatgtatgggggggggggagggggggggagatgcgaacgcccacactggtgttggttcgtccgccacggaagctggaaccccatcggacgtctcggcgccctgtttgcaaaatgtcaggtacttgtagtgcattccacgtaggaaaatggtcgtgaggggagggggggctgagtttttctgttatgggtatcctgaggggtctacgtgaaagtgactggccttccgttttcccacagaaacgttgtgtggtacggtgcaccctgagagatgatctatattctcaggaagttccgtgcccgaaacgctctgaacgataagcttctagattgcatcggggattcctctgagaagagcgggtggggaaatacatagccgttaaagtctcgcggtccgatatccccgtttggccggtggatgagtcgcgatggccggacggggccggaaatgcgatccttcttttgcgggctatttgcgatggaagggaaaggcaaaccggaaaacttaaggccgtttggtgtgtttttcccttccatcgcaggtcgtgccgcagtacttttgaatcggagggagacgtcgggcgagtgggaatgggcatcgcggggtcatcctttattctgggacgaccgcgaatctacgtgtcgtctcagtctggacggcccatggaaaaaaaaaagagtcgagaggcgtggggggggggggaggcctgaacggccggcgcgataagggatacgtggtcaatcttggcgattaagcctagatattgcgcggggagtggggcggcggtccaatgcctagaagggcattattcgaaatttggagtcgggctgcgtagcgacgggtggcgcgcattaatacccctatcttttttttttttgcttcgtttcttgtggccggcttgggaaatgtcagcggaaaacatgcacccgctgtgtgaatgtaaaccgcgtaagtaaacccgtgttagactagatttcgcaagttgcgaaggggggcgattggggaggaggaagtctgaacggaggggggagaagggaggggggagggggaaggctgaacggaggggggagaagggaggggggagggggaaggctgaacggaggtgggagaagggggaagaagggagggagtggggaggggggggggagaagaggggaagggggaaggggggaagggagggggggaagggagggggggaagggagggggggaagggagggggggaagggagggggggaagggagggggaagggaggaagaggggagggggggggaagggaggaagaagggaggggggaagaagggaggggggaagaagggaggggggaagaagggaggggggaagaagggaggggggaagaagggaggggggaagaagggaggggggaagaagggaggggggaagaagggaggggggagaagggagggggggagaagggaggggggaagaagggaggggggagaaggggccctggcgagatcggctctgaattcttcgttgtagatagcagacgaccgtaaacctgaagtacctgtgacttggacggtgatgagatgtttggcctagttacagggactggcctttgttagacacgatggcctttggaaacgcatccagtctgttttggcatctgagtggcgcgtagccgttgtcagatgccagagagactgaaatgtttctcgaggactctaaccgtaatctgaataggcccggaccttaatcccaataggccgtgccgggatatcagaggagagccgctcggaccgctgcgattccatccttcgactagcgacttgttatggcgggtaatagccggacgacggagtctcggcggttcgaccttagcgggccccggataggtttctcggttggggacaaaggggaggtagaggcgtcggatgcggggcgatgagcgggtatttaggccacgagatcaggtgttgtgaggaaggggtaacgacgccgtattgcggtcggaccgcacgacggcgcgtcgtccagtccttcccgggtcccctagaggtgtcacgttctaggacaaccgggacggacagggcgacgcgcgcgaaatgcctcgtatcgcctgatatgctcggaacgagtcggggaagggcgcgaaagcgagagttactactcggaactcgggactgttcgtatgttttctctcaggctggcattgcacgtgtcattgccgttgtgcaatgcctgcggagagaaagacgaattgattccccgtgccgctccccgtcgtgtgggacaaggttgggagggctctgggcgaagaaccggctgagcatcggcgcgcgcgccgtgtcccccctcggcggtgtgcacgggagtatcgggcgccgtcctcatgcccccctccgagggtagcacgcggtggtcgctgcggtcttttcaaaacaggttctgcgaagcagagatgcgtcggcgcgcgagcgaagcgaaccgagctctgctccgtccttagcgtggtgcctgagattttaacacgtatcgtctcaagtactgcgcgcaaggaccgaggcggcgttccaaacgtcggacgggacggcgcggcgtcgtcgcgcgccgcggaaatcgttacacgctccgcttcctccttcgcggggtgcttgagatcaccgaatgacgggatcgagcaccacgccgatggacggagatggcgcgcggtacgttcactgaatcgcaacgaggccgggccgcgctgcagggatggccgcgggtacgcgcgccgagtatgggggggcgcgtgctctcctacggccgactcttgggagcgtgcatcgttcgggggtcggctgttgggtaagacgtggtctctttcaggtcggtgctgttattttcggcggggcgcgggacttcgtcctgggccgtcttacacgcacgtcactctggtcgtatcggtagtcctagtggcttgcttgtaggctgtccgtcggaggaagacagcaccgccgcccagctgcctgtgcgagcgcaggactcgtgtccacgtcctgcgtgactgttcgcccgccgttcggatggtccgtggtacggtgtcctgtgttgtgtgagaggtctccgtacaccggaccatcgaaggggggtgggggggatatgcgaccgcagagcgacttttaggctgccgctgtgcagtgttcggttgggtggggagggaggaatgtctgtaaatcttacggcgatatgctggatcgtgagaggtgagtacgtgtctgtgcgggtaggtgggagcataaccacaaaaagactagaattctgcccgcggggaaatggcggtgtgtgtaatgcttctgttccaaacgaaggtgcggaataggagcgaaatggaccgaccttcccccgcgacgacgtaagtggcttgttacgacctgggaggcctagctgtgttctcgctcgttgccagtggataggctcgcccttttttgtaacagatggcgatggaacagaggttcctatgtgggggggggggggcgggaaggataacgtctatcgatcccgaagtcttcgttgcggatatgagacgatcagtactctcaccgatctgcatatcggacgcggaggggcgagagagggcccgtggttaggcgtctgtactccgaactgcttccattttttcccttacggtgcctgacgtcgtattttaacggttagatgccgtcagggaaagatgggagtttgtttgctcgagccctgccggcggactgcaggcgaagaagtagccgggcgcgaagcggctgggaatcgggtcgcgtggcgtgtcctccttcggacgagtgcttgccggggagtaaccgtcatgcactactccgggggtaggacgcgacgtgcgacgcgctctccggatcggtgccgtgctgcctgagatcgagagcatcggacggagcccagcgccgtcctttgtgctgtgtgtgagaggtcgtcatcccttctcgggcaccgcaccgaaggatggagtgggccctcgaaacgtcatccggaacgccgcgggacgaagccgccccggtaaagtccagacgcgcgcagttccctccttcgtccggtgttcgaggcgtgagacttttgtattgccgcgtcgagcaccgtgctggaggaaggagatggcgctctactccgggacgaaggcgctgcggagcgcatcgcgtggtgttagaggtggatcctgtcatcaagcaccacgtcgatggacggagactgggcgcgaagcgttctgcgggatcgcgtggaacgagggcgcaccctcggtcgcgattttctcgacgcctaccctcggcgttgttcgtcggccgagggtaggcgcagaggaaatcgcggtcgctgtggactccggtgtctggtatcatgtccggctcgagtcgtacgtcctgaaatgttgcttctgattccgacgggtcttcttcacgtacctctctatggctgcatctttatggccatagtgaggtacgtgtaggctacctgccggagaaaggcggtcccgacgaatacgcgtcccgtgtagcggtcgcccgctctgcgatgggctggttccggcatcaatattgcagggtctatttttgtggtgggcgtgaccgcgcatcgcatcgaaataaatctttaaaccggccgagttcattgttgggctatgctcggttttcggggggggggtgtggaaggagggtactaggttagggttagggtcgggcccttagggtcatggtcagggttaggcctttaaggtcatgcttaggtctttaggggcagggtcgggcctttagggtgatggttgggcccttaggggcaggggctcggggtaagggttagtgccagggtcgggtgtcagggtcatggacagggatatgccgttaaggttagggttggggtccaaagttaggcgtttaggggtcgggtcgggttcggggttaggcctttaggggttgtgtctggtttagggttaggcctttaggggcagtctcggggtcgtggttaggcgtttaggggtcgggtcgagttcggggttagacctttaggggtagtgtcgggtttagggttaggcctttaggggtagtgtcgttgtcggggttaggcctgtaggggtagtgtcgttgtcggggttaggcctttaggggtagtgtcggggtcggggttaggcctttaggggcaagctcaggtgcagggtcggggttaggcctttaggggcagggttagggtcagggtcggggttaggcttctggatcgggtctttagggtcggggttaggcttctggatcgggtctttagggtcggggtgattatgatcagagactaagagcgcgaaggcctatcagtgttaggttctctgggtcagggttaaggcctcggggttagggtctcaagggcggcgtttggcttaggggcccggggttaggacctgtcaaggtcagggttatggcctatcagagttcgtggtcacaggtgtaagggttattagggcctattaatgtcaggccctattcgggttaggctcccaccgagtactaaggttagggtcttgtaagggttggggcccgtaagggtaggggctggggtctgttacgggcagggccccccccacacggttcgacctgccacgcttaggttcccatcccccctcccccccccgagtagggttagggcctggcaggggtagggtaggcgcgaaggttgggcccgttagggctaggagcgaccctcctccccccccccattattgttagtctgttaaggaggcgttccccctccccgtcagggttagggcctgttaggggtagggtaacagggttaggttaggggttaaggtctctcggaattagggcggggcgtgtaatggttatagggtcagggcgtgccgcggattgagggtcggggccggcgagggtgtcgttccggtgtttacggaaacggcggatgtgcgcgcatgcgctcgcgcgcgagccagacggacggacggacggacgcgtctcgtagcagcattccatgggcgtttttattcgtactggccgacggcttcagcccgggtcggggctaggagcgcccgcgtgcgcgatgaagccgccgtctcccggcggcgacgcaaaggctgcggtccgcggttcccaagcgtcctgcgtccccgccattgctgcaccgctgccggaaaaagaaaaacatcctgtacgcacttcccgagcgccgggacagaggcggtctccgccagccccccgcgaaattccaaaaagccggtgtggcggactcggccatggaatctacggggggggggttgagggggggatgcggcgctgtagtcgccggatgcagtcaggacacggaaattaagcgcgtccggacgtgccggacaatcgcgtacgcggaagtgcttgcacgggaagtaaacagtggaccgcggcttaccttcccagcaggagtacggtgttcgcggagaaaactgtaaggcgggagcccatcgtcgtgcgctcccggtcctctcggaatcggctgcgagtctcaaaaaaacaggaaaggggatcggcctcacaaaaccacttcctcattcgtgactgcgcgtagcctccgttcttgaaagcggttggcgttcgcacagacctgagtcgacaccgcctacctgttgtttactttcaatgtagtgcgttgcacagagacgctcggggccgggtacaagttgcccgggtccgcgggtctgaagcacgcactcttccgttgaaggacggggtgggaaagcggattattggaccccgcgatagggtctgttagggtcgggggttcggcctgtcatcacggtcggggttagggcctgtcttattcgttttagtgcctgttagggccacattaagggcttgggccagggccgtttacggtggcggttagggcctctcggggtcggcgtcaggactgttagggtcactgttatggcctttcagggttagggtaatagtccatagtcggggtcaggacatattaagggtagcggctttggcggttacggcatgtagggctaggaccttttaatgtaacgggcagcgttggtgtcatgtatcacggtcggggtgactgttaggcctcgccgggcctcatttcacggtcggggctatggcagggtcagagtctgtggtggtgtgcttcggtcacccactgtgtccgcgcaatgctgcgcgttcattctgcctgtagccgacagttcgcggggtgcggcagcccgcgggctgagtgcacctgtggcggcgggaggctgcggcccagccgcgttaattgttgtgctatgttccttttttggggggggggtgaaatgcagggggggatattaagttggttagggttagggttagggttagggttagggttagggttagggttagggttagggttagggttagggttagggttagggttagggttaggccgttagggttagggttaggcctttagggttagggttaggcctttagggttagggttagggtgaattttttttattcagttcgccgccgcgagagttttggtatgacgtttggtggtggccagggtccgccgcgcgcatgctccctacggtccgccgcgcgcatgctccctacggtccgccgcgcgcatgctcgctagggtccgccgcgcgcatgctcgcaaatgtcgactgcgcgcatgcgcgcacgggtccgctacgcatttccgggcggcctagcgagcgcccgcgcggccggcgggcatgtccggcggggatgcagcgtgcggctcggcctactggccgcgcggagccgccggcggtcggcggtctaacgcttggagtcgcgccccccccccccccccgatcagacgcaaggctttttcaggcgcccgtctcggtcacttaggacagccgcggttcgtctcgaaaaaggtctgcggcgtgggtggtgggggaaagggggaggggcagaacagtccagagaccgtcacgggcgaacgattggggtccgcggggggcgcgaggtggactcggtagccgccgcggtccgatccggaaaccgtgtcccccctgcgctttcttcgggcccgctcgccgacgcgaatggggtgggggaggggggtgcgcgggcgaacaattagggaccgcggagtgcgacagcgggcctcggtagccgccgcggtccgatccggaaaccctgtcccgctgccgctttcctcgggcccgctcgccgactcgatcagaaacccgtctcccccgccatttttatgtctcccgtatgcgcgctcgttcccgccactttctggtgccgctgcggaagaggatagccgggcgggcgagcgggcgagcgcgccgcggaccgaaccgctccgcgggctgcgcaggggaccgcagagattgctcccgcgcgagggatcgatccgcggggtagagggctctccgcgaacagcgtaagaacagaggtgtccccgcgcgccgctgcctccggacgcaccccccgcccccccccccccggccacccagggcgaccgaaaccccctgccgccgccggcaagagtcggtcagagagcgcgaatgatgtctgtcgcatctggtcccttcattcattcattcattcattcattcattcattcattcatttatttatttatttattcgccagcgctacatctcaatcccagctaccgttaaccctaccaccacccccccccccccccccgaccttgagcggttctatccgttcgagatgaccttcacggagcggagctcgttgcaggatccggaggagcggtttccgcagccctagggatcgcgattcttcggtacagccgcgcaggccttcggaaaggacgcggcgatctgagtccagggggccacggctccgcgcccgcggtttcggttcccgggcagaccgccgtcggggacccccgggagctttcggagaaggtagggcggagttctgaggcttgagggacaatgagcggcgggtcggttcggttcacgtcgccgtcgggatccggtgcggccccgtccgactttgccgtgggaggctccattgtccgtcccctcccccctttggcggagcgcagggcgaaaggaccccgctttcgccgccgctcctcctcgtacaggccacgggtcttctaggcgctgtcgccgcgcggtcttccttttacgaaactttctctaccgcgtttgcgggagaacactacggcgaacgcgcccgcgggctcgccggcgcttctgcgctactgaatggccgggcgaaggtgcgcgcggggcattcgttctgggaacaggtatagaggcgtggccacggccgaccaatggaccaggcggtgacgcatccgcacggcagaccgcggcccgtacgactaacagcgcggaacgcaaccgagccgcggggttccgctggccccctaatttatttgtccgtctccccgctcgcggatgatatgtcgtacccgcggggctgcttgtccagatagcccttaaaagtccgccgagtgactccccccgcccccccccccccgaccctgacttagccttcactcgccgaagacttcagagtcgctgagggccaagggcgaaggaggaccgggcagcgtcggaggatgaattatcctctgtcgcgcgccctgttcctcctggacggtggtctccggcggaccgccgtccccttccagccacactacagacgagctacgtaggtgagcgagcatctcgcgggccaataaactgcacgtcgcttcgggaacgtgaacgacgactggctgggcgtgcggatcgggggggaggactacggagcggcaaacgtcgcagacggtcctatttaagaaatcgggggaaactatggcgttctttttgggctccaagacgtacacgggacgcagcggggcgtacagtccccacttgagagcggctcggtgggagtgcgactctccagctaaaaagtcggggccgggcggcctctggcgcccggccacaagggccgaggaggctgcgaggtaggagagagcggtcattgggaccgtcgcgacgcggtccagtcgcgtcgcgaccttgtatcggacgttgcttccgcagcacagactgatgtcgccggccgcggggttttcgcggcgaaagtgcgtttccagctcacgtaggaccacggggcccagcacgtcccgcgaggttatgaccgtcgtagctagatcggggtggccaggccatcggacggagcattggctgcggggcgagacggtgcacctgacgtagcggacggcttcttccacgaggcgcgggccgttctccgggcgatcttgatcctctagcgtgtccaggaccacgagccttttttctcgtttcaaacagaggcgttgcaggtgttccaggacgcccgcaaaaccgaggtcctgaggggacaggaacatgacgccggccgcggtcagcgccgaaacgtccggcgccgctctccaccggcccgcccaggcggcgctctccggtaggcagaggcggttggcgagtgcggcgagcaggaaagagagtcctccccggttcgggtcgaaccggggtcccccggggggcgagccgggcgccggtacgcaaaacaggtgctcgcctgggttggccgtgtacaggatgacgagagcgacatcttcaggcgaagcctgctgatgccgcatccaagcggtgcgcgctctgagagagacgacggccgtgcggcacaacactccctcggacgcagcagtgtctgggcttctgctgacgtgcgagggagtgctcgccacgcgagcgatctccgccatggcctccggagaacgcgccaacggctgacgccacagagtcggtatttgggcgaagctggtcagctcgtcgactccttcgcctggacaataggcgtcgaggtgcggggggccggcatagccagcaatcggagttccaatggggggcttcctaaaggcggcgccacgatgccgtcgatcgcctaacgacagggaaccgtccataatgcgcgcggggtcgcgccacggaaagcaacgtgggcgcttgggcgggaaaggcccggcgtcgcggcacgcttcagggggggtggggggccttgtgcagctggcgacaggcggaggtccggcgcctgtccgggaccttcccaaacgcggacgcgggttctcgacggcgttgtccgcgccgtcgagaaccgccgcgggagctgattttctcttccttgactcggctgacgtttgggcgcaaagggcccgcacgggctcgggagaacttgcggggccggggtcgtaacaaggctccgcggagcgcgaccggccctcggacgttccggaagaggccgcgtcggcgtccgcgagaaggcgcgccacgcgttgcagccgtcgggccttctcgcgggatcgtaccggttcgcccctcgacccacattcgcgcaggagcacggaagtaatgtccctcgacccagggcatcgccaaggccgagcggggtctttgctaagcaacgggccgatcgcttccgttatcagggccaccgcattagccgcgagagttcgctcctggcgcccccgaggagccgaaccgttcgcgtaggccgcgtacacggcgctcctgagatcaagcaggtctcggagccacgacccgagcagagcccggcatttttcccactgttcgtggccggcgggtcgagggaagggcccgtcctcgcaagacgacagcatttccgcgaccgcgcccggaccgtcgggtccgcgcagaagcgccgccacgaccccctcgcactccagcgcgcaagcgtccaccagctcgttcagcggccgggtagacgcgaaaccgtccccggcagggatgtccggacgcgcgggcgcgaccaatcggtattcggggacgtccagcaggccctcctctagcgcggaattgaaggccgcgacgccccggcgcacgcggtcgtggatcgtggacacgtctattaccgggatgagcccggccgccgtactttgggcagtgacgggtgcccgatttgaaataggcgatgccgaggggcgtcgcatttcggcgctggctgcagacgccataggcgcgtaggctttcctgagggagcggaacatgaactctttctgatctttgcagtacctgcgagtcatagacacgctggcggcgatgtgcggtagcgcccaaagcagatttcgcttcttcatggcgctggctatgtggggtatgcatttgttgaccgtccccgtgacggccgcgcccggcgaactgtgcgagctctgaaacttcgtgacatagatgtgattgagcgctgcgtcggtgggcgagagcttgccgtggtgtgcccagttcagggggttcgccttcacgtctttgttaagcatggcgcttacgagcgcctcgtactgtttggcgcagttccccatttcctccacgtacaccgggaggggaccgggagtagagaggaatctaacggcggcctgctctacttcagggatgccccggagcgcctgtcggtgtccgccgagaggcccgaaccagcaccggccggccggcggggagggaatttgccaccacacctcttggtcgaggtcatccggcggtggcggcgcagcagtttccgaggacggtgatggcgcccgccggccgcggccgcgccgtcctccgcggccgcggccgcggcctctggcagcgcattgaggcgctcctgcctcgcgggtcggcgacctggatgaggtgcgcgaagaaggggcggcagacgactgttccgatgaagagggcgcggacgacgaagaggacgaggaagaggaagcggacgaggaggaggaagatctggagcgacacccgagcgaagggtacgaggccgggggaggccggggtaggggatgggaagcgcgggtcgccggcgtgccaacctcctgttgtaatgcctgttttagaacagcaggtggagctgttgtgtgcgaaccatcggagcccgatcccggctggactctgcggtaacgttcctgcgtaccggtggggctgctaacgaggcccggcctcggagacggcccgttccagtctggaacgggaagggggggaaacatgggcgctccgtcgtccctcgcgccggacggctgacggaggtgtctgaatcggcgtagcgccgcggcggtgacggcggcgcgccaatcaagtatggctttgtacagaggtctgacccgtttttcgatggccggaccgcaggcggggaaccccagttcgaccatagcgacggcgagctgctgcaccatgaatccgtaggcgcgtgcgggacgagagccgtggggcgtcccgccgggttccggatttccgttccgcagcgccaacttcgattccctgacggccgcggaaagcgcgggagggagcgcggtggcgggcggggggggcatttcgaaaggcacctcgaagccgggccgcacgtcggggccgacgatgtagtcgtctggggccagcagtaacccccgacgcactttgaaaaaaagacacctgtaatgtagcatcttgaaatcgttccaggtgagcccggtccaggggttcgggctgccttcccggccttccacccaccgaatctcctcgagcagaggacagaagttggaggcatagaagccgccgcggcgccggctgcagtcgagaccgcggggggattcagagggcggcgttccgttccagtcctcgtccaagggagtacccgcgcccggcggcggcgcgcacgccggaaagcacggcagaccacgagccgcttgtaattgataggaaaagtcgcgtgtcagaacgtgggccatgtactggacgcgcctgacgcagcggagtcggtccagccagcggtatgaaaggcggggaaccttcgacacgaaatcgggggtgacttgaaggccgaggaagcgaaggagcgccgacaaaatgtaagcgtacgtcggggtgcgcggagccggtctcgggagccgtgttaccgcttcccagatgcgcgttggcagcactatcggggcggggagggggagcgggcactcgttctgcgggccccatccgcaaccctgcgattctaacacgctttccccgtcctcggacggcgacatatcgtccagggtcgagagaacgaggcgcgcgcatcgagaaaacaaccacatcttgcaggccgcccagtcattccccagctcgttcggagggcacgggaagaccggctcctggggcagcgggcgacccttcgcgcaacgccattcgaacggccggtagtcgctgtcgagtaaaggggcctctctcggcagttcgatagaccccggtgaggtccgcagagggctgccgcgcggagtaggtaagatttctctgagtaccgcttccctcgccagccgatcccagtaggaagggcaccggcgagcgtccgacaacgcgaggagaaaaaccttagggttgtctccggaggacggctccgtcgcgccgtcgcgagcccccgcgcgccacaacatagcgtggctccccggctggcgggccaccaactcgagctcttctcgagggggggatgggatcctggcggatgcggataggcggcagacgtactggaagcccgcgcccctggtacgggggcccccgccctcggaaacgctcgatttacggcgggctgggactcggtcgctccggaggggagcgggtgcgaggcggggggctgaaggggacaacggaggggaaggacgctgacaagaagcagagagggctggggggtccggggaaagaggcctgtcgtggagaggggttggcggaggtggggtagacgccggaggcgagtcaagcggtagagacgcagacggggaggatgtctgcgtagagggaggggaggtagacggcagaggcgtggggggaggggaaccgtgcggagggggggtatgcggaggtggcgtaggaggaggggggctaaggggaggtggcgtaggaggaggggggctaagggggggtggcgtaggaggaggggggctaaggggaggtggtgtagggggagtgggtgaatggtgttgagcgaacggtcccggcgtcagcggagaaaatgtccatgggaagttcacgataggttcgggggggggtggggggggcacgcccgagggaggggggagagtttcgacacagacggcgagcggcgtgcaggcgccggtgggcttacagggcgcgtcagatacgcagcggacggggtcgtttgatttgcggggatccatagggctcggttcgccccgttccgaacccgcggggactagatcgccgactgtcttttgccaagaacaggaccgcggggccgccgcggccgtttcgtttccacagacgtccacgatgtccgcggtggaactgacgacctcgccaggagacccctgatgcgcgccgtcggggggttcggcggaacggagacccgtatccgaaccctccgaaacggcaccctcaatgccgaaaggggctcgtgcgccggcaaggctgcccgcgacgggagccgcgcgggcaggggatttagaccgtggcgggacgggctgccgaccgggcgtcgggggcacggccacgctcggtgtattcaagcacacgtcctggtacggatctcccggggtggcgggtggctgcggagaaaatccgccgttgtcggctaacatctctaacaggctgtagaaatcgggcgggttctccatgtccgagcaatgggggaaacgcgcgccggtccaaccgtggcgacgccggcagcactggcgatccgctccttacaggggcgtaaatgcaggggttaatcgggcggatggggaccagcgcagggagcgcggaaggagtcctgctctgaaaaaaatgagggggaaccgtgagaaagcgttccccgcagttcgcatcgcttcttgccccccgcccaacaccaccaccaccccgcccctacacacaccacagccacggctccggcagtgccggcctggctactcctttaatcattaactcccatcaacgcgatttgatccccgggctgctctccgaatcagccgagccccataggtaaacattccgccgcccacaacgtttcttgtcaaacaaacgcttatcggccggattgcgaaacgagcaggttttgccattagatatgctgcggtcagcgctgctaggctccccgggggcaaacattctcctagcgacgccgaggtaaggagacattaaccctcgacacgctcctgcgagcgactgtgcggttcgtgcggtttgtttctctcgctcccgacgttcctaccgccctcgggagagtgctcgcccgggggctagaacccgaagcggaccggcccttgagcatcgagacgcttaggctcgggcgaaccgcccggctctaaaaagtcaagcgcgcgcgtgtatttcttttttttgggggggggggggggggtggtggtggtggttggagacagaagaggagagaaacggagggggtggtggtggttggagacagaagaggagagaaacggagggggtggtggtggttggagacagaagaggagagaaacggagggggcggtggtggttggagacagaagaggagagaaatggagggggtggtggtgggagagaaataccgacggccggacagagcgaattattaagcacccaacgctcacgccaacacgtcccacctctttccccgacccgcgccgccccccccccccccgatattcgcgtcgggggtcagggacaaagagaggcgacggggcaataggcgctgcgtgggggagggggggccggccctacttgcccctaacgcaccggcgtccacgcgatcgcgcgacccgacagcacctaccaggagcgcggtgccggcggcagccccttctcgattcggctcggagctagccgggagagacggccgcggtcacgtctccctttccgaacgcctagcgatatagttacagaccgaagcgagccgtgtcacaccaagtcacttagccgcaattctgttccccttcccccacacacataacaggagacatagcgcatgggaggggctttccttatctctcgagcagaggtcgccgacacgtcaacgaagggcggtacgtgtgtggtaagtagcagagatcggagttggtcccgatttactaacatctaataccgatcgttcatagccgcctggaatttgcgggcataacccgcggataacggtactggtcagggaagcaacgcagcgcagacacgacccgatataaaagactgcaaacgaggttttgtaggggtaatgagatgatgtggaaaagaaatgggtcagggggcgctgtttgttgtgacacatttgcgcctagtgtgggaccggggcgtgcggcgagcacccagcgcggaacgactcgcaagctgacggtgcagggctaactcgcattagaggaagtgtttgctgatttcttcgtagacgctctgcgccgagagcgtctcctcgtttaacctttatgaagaaggaagtcgctcccatctggtgcggaacgatggggtacttctctccgtaatggggaaccgaaaactgaaccaaatacagaaattagaagaggaacatcggcttttcccgttatgtaaaaggaccatggggtcgcgtccgggaggagggggagagtttggggaactcggggccctaagagcgctacaccagactcttcataataccatatgtcaaggcagttgcggtaaatatagcgacgaccgcaaccgaacgggtatttcttctacaggttagaaccatcccatgacccatgcgaaaagtgttacggcacagagaaggccagagggaaactccgcgtccggcaaagcgcacggtaagacactcgcgaggttgtgcaacagcgcatcgccccgggtagaaccgacaggtttatcttcagatggctatcgcggacaactcgtcgtcggggctgggggaggggggggtatgtgtcagccacttccatcctcgtcgctgtcgtcgctcgcaaatgtgggctatcaacgcttctcgattaaaaaaagacaaactagaggggcatccgcaataaacgacaatgtttcatcacaaaacaaatggcgtggtctattctttttcgtttgcctctgatcctgggcggtccgtactgcggggtgatagataaaagaagacaacagcagggaatcgaggtggcgagctcacaaattgcgaagctcagcctatgccggcgatgatggccgatgagggaatgtaggaagagagggcgtatccccgattgacgatggtgcgaccaccaaccgagtccgtgtactcctatcttccattctcacgacaccggacatgagaaacgatgcgcggagcaagtcgggggggggggggggaatgaatccacggcacgcgcagcgcttcctttacattgcaccacgtgaccatattcccataatgacggcaggcgttatctatataatgccaggcagaagtcttacttccgctcgcgatcactattgtcgtcacacggggagtctgactaggcggtatggacggcgtacgagacagagtattacctgatacgtcaacggacaacgagatctaccttgggtcggggtatccggtgcaattacatgatgaatatgggcaaatttctctaggctcgccggtcgaaagcagcaatagcacaggaaatttttgtgctccgccatggatgccggatatccctcgtttaagtaatgatacatgtaagatatttcggtgtctgactagctgtcgtctcaattgcgcaccgttccacgatgctctcagaagagccttgctcgatatgcacatgttaggtcgaatgggattccgtctacgacagcacgaatgggaacgtatcatgcagttgactccagatgagagcattaacctgcggagaactctcctggaagccgacgagcggagcagtcattgtatgccgaacgtgtacgcatctgacattagtaattccctcgaagctggtacaatgcaagttacctccagctccaatatccggggtatcagcaacaagtccgtaaatcactgattacaaaactcactgatgtagacgaacaataaatgtcctattgccagtaatcactttgcctgttatttattgaatgagtatgtcgcgttaattaagtaacgcagtgtgggcgtgacttgtaccatatagatttctattgactacaacgttatccgacctgacatttgggagctgggtgtctatagagacagaaggtgcaccaccgcgcaagataatattgtgatatgtccagtgaggtatgtgaagtaccatcaccgcaaaagcaaatgggcctgtggtcggtgtgccgcaaacttcgcagaacatctcatctgtggccggatcctgcgaatgagaaagtatacggtatactttctgctggtggagtacatatatcatccctgccaaagtctgtacgcggtttggcccgaactgtattgaccgctgccatggtctctttcgcggcaatgaaagctggtatgccgccatccattcacctgtggcgtgagataatggatttaactgacgcaacaatccgccgcgaacaacggtccacatcaaatttctacgtagccggttcgttgaggaaaatagtaagtgttgcattgcgaaattataagcatgcacctgaaacgcatggagaaatggatagccgtctgactgctattatgtattggtgttgtcttgggcatcctggctgctgtattgtttcccatttatatgaggaaaacagtgatctgattaagttgttgggaatggcaacaggctgtggagaaagcccgcttactgaagtagagtcttattggaagcctttatgccgggctgtagcagcgaaggggaatgcattaatttacgacgacgtcgaagtggcacattacctgatcaacgtgcgacaatcgtctgaatcttcgcctccagacgatggggaagacattgagtaaatttgcgcgaatgacagggctcggaaacaatgtatagagttttgcaaataaacactttattgacttaccagaagttattgcatcttattgtaatctgcgtcaatattctctaacttcagttaaaacgtagcaatcgcagaggggcaaactagagaaaaatggacccgcgacctaaatctcgtctaaaacgctccagtgctttacagttcgataatctggacctggggacgcgtataggatcgttcctccacatgcgctgctgtcggtatctcgaatccccggtattcagttgaatcgttggcggagtgtcctcctggactctgcaatgttccctagccgtcttcactatctcgtgcaaggctctataatacagttcctctgcagacccgtcgttgctcttcccttctgcgtcgttagttatttctgtaggctccagacgatttgcctgcatttgtgcgcaacataatctgattgcattccctatctcgtcttccggtaatcccataggtgttcggtattcgcagataggtagagaaagcaccactgcaaatcgtgcaatttccattgccccaaccaatattttttttaagaacggcatcgccgttaatgtacctcgggcattgtgacgatcgaaacccttatggatgcctaaagagagcattgcggtccagttctccaggtgaaaagagaatagcgcgggtagaaacgggccgattagttttatcttcgccgcgtccctaatatcccaagttctgcagtataacttccatcgtccgttttcgacaaggtccggcgcgacatagtttgaaatgtcatctatcagaaacatctcgcccatcgtagaaaaaaacctgtacgcagaccataaaaccattcggtaccacatatccttgtgtatatcaaacgatatgttggttatgtcgttggcggatgttgtatgaaatagagctaagcgttctctggattccacgcactgaacgattccgttagtcaattcatctgctaacataggccaaaagtttattcgtgttacttttctcggcggtttggcaaaacgcccccttggcacatccatgtcattaaatacagcggcataactcctactcatgtgttccatagcccaggtttctgttcggtctgctactacgatcagatcagtggcgcgatcagatgcgtgggatgaatgaagtgtatccgaaagcagttttgagatatacgctaaactgtacgacgattgtggcactaaacgaagctttgcgcgacccccatcccacgcggagtctgtgcaaggttaatgaccctcgcagttcattcggaagttataactgccgccttcgcacatttctttttgtcctgttttgtattgccataacagataggaattgaaacctgatcctcctgttttttgcagcatggccagcaacagaatactttgtcggatcgactacttgcgcgagatggttccgttcttggaggtttcggcgggtcgggtggagaacctattattttatacacacacgtcataccgttgtcgcgaaaatgttctttgtcttctgccgtctcgaacgtcggttcccacgtagacgttaggagcgttggaatggtatcaggaagagcccacggcatgccggaccaagtacccgctactttgaccgcgagcagtctcttcggtaatgggatgtattccagagcagcgcggcagagatcagcggcccccactatccacagactgtatgaagtgttttctgaaacatcggactccaacatcaaatatccagacataacatcttgccattcggaagcacatccgccgacatcttcaaatagcctaactataaacgagtctctagttcctgctaacccagtacctcgaatgccagtcccatccggtgggttcgtcctgataatcggtctctgacgccgaggaagaactaaaaggggtctggaaaagcggaacagatctgcagaccgaacgactacagacacgcccacatcatcatgtatctgttccatgcattgctgtgatgcggcactcgatctcggccataatggccgtcgactctagaggatccgaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatccccgcggccgctctagatcaagcttacctccttatagcccggattatgtctttgaagccaaatgctcctgcaatcttcaggggagagttgaggtcggccacctccatgaagtactcacgaaaatcagtgtactcccttgttggccagacggtcttgatgccaagacggtccctctcactcagtatcaattttgtgtagttcatggctcctgggtcaaatcggccgtattctgtaaccaggttctttgctagttcaggatttggaatcagctcgaagttactcaccccagcgaccgtaacgacggatcctgttgccactctttcgtaggctactagtgtgacgggacggagggcccctggatagttgccaccatggatcgtcactgctaggctcccacttgccgaccatgacatctgatcccctgcctgaccaccacttttggaggtcactatctccagtttgatggatgtgattggctgggttatctcattggttggaatgacaagattgaatggcataagattgtcggtgccggccgtcagcccattatctgcggctacagctctggtgattaccgcagtcccatcaaagcctataaggtagatggtggcgcccagtacaaggccttggacgcttgtttgaaacacgagctctcccccaatgctgaggcttgtgatagcatcaatgttggctgagaacagtgtgattgttaccccacctggttggtactgtgatgagaattggtaatcatcggctgcagttatggtgtagactctgggcctgtcactgctgtcgcatgtagctaccatttttgggtcaagccctatagcgggaatggggtcaccaagcctcacatacccaagatcatatgatgtgggtaggctgaggacagtgaccccttcccctaccaggacattcccaattttgtcgttgatgttggctgttgcagacatcaacccattgtagctaacatctgtcagttcactcaggcttccttggaaggtcacggcgtttatggtgccgtttagtgcataaacgccaccagggagtgtgcttgacctcactgtgagactccgactcactagtctgcagtagttgtagctggccggtaggttctgggcagtcaggagcatctgatcgaacttgtagttcccattgctctgcagtgtgtagtgagcacccacaattgagccagggaatccagggaaaaagacaattagccctgaccctgtgtcccccacagtcaaattgtaggtcgaggtctctgacctgagagtgtgcttctccagggtgtcgtccggaatggacgccggtccggttgttggcatcagaaggctccgtatgaacggaacaatctgttgggtttgatcttgcaggtttgtcatcgctgctatcgacgagttctagagcggccgcctgcagcgaggagctctgcgttctacggtggtcagaccgaagactgcgacggtaccgacgctggtcgcgcctcttatacccacgtagaacgcagctcagccaatagaatgcgtgccaatatggaatttccaggggaaaaccggggcggtgttacgttttggctgccctttcacttcccattgacgtgtattggctcgagaacggtactttcccattaatcagctatgggaaagtaccgtttaaaggtcacgttgcattagtttcaatagcccattgacgtcaatggtgggaaagtacatggcgttttaattaaattggctggaaaaacccaatgactcacccctattgaccttatgtacgtgccaataatgggaaaaacccattgactcaccccctattgaccttttgtactgggcaaaacccaatggaaagtccctattgactcagtgtacttggctccaatgggactttcctgttgattcacccctattgaccttatgtactgggcaaaacccattggaaagtccctaatgactcagtatacgtgccagtaatgggaaaaacccattggcttacctcccattgaccttatgtactgggcaaaacccattggaaagtccctattgactcaatgtacttggctccaatgggactttcctgttgactcaccccctattgaccttatgtactgggcaaaacccaatggaaagtccctattgagtcagtgtacttggctccaatgggtttttcccattgactcatcccctattgaccttatgtactgggcaaaacccaatggaaagtccctattgacgcagtgtacttggctccaatgggactttcctgttgattcaccccctattgaccttatgtactgggcagaatacaatggaaagtccctattgactcacccacattgaccttatatgcttgccaacaatggaaaaacccattggaaagtccctattgagtcagtgtacttggcagcaatgggtttttcccattggctcacctcccattgacccaatgtacttgggcaaaacccagtggaaagtcccatttgactcagtgtgcttgccagtaatgggaaaaacccattggcttacctcccattgacccaatgtacttgggtaaaggccattgagtcaccacccctatgctgggaaatggtgaacgccccctatgtggaaagtccctatgggccgccattagagtgcatgaccgtgttgattcatatgccatatgagtgtattagggggctttccgcttgggaaattgggtaaaaagtccccgtattactcacatagggggcgtttggctttgcaaattaggggatttcagtgcatttggcattaaaaactattggttctagtcataaaacgggcggagttgggggatccggcctaggcggccccggtgatgcggcactcgatctcttatgagaaaaatccataaggccgaggcggcatctctagatctcccggggagtctctcgcactcatctaggagagtgacgacagttatcatagacacgcccatttgtgcaccaaacgaaaagttcctgtactggtggagcgtcggcgcgggaatcggtccgtgctctgaaaccagtgtctagacagaagaccatccggtaaattctggtgtatgaactgacggtctccagacgaacgtcgaagacattaacgatggaaactaacgagctttcttcaaaagtgtctgattacaacgctaatagaccttacgaaactatacgcagcgataccagtgacacagatccgtcggtgtcgtgtgggactctctccgacaaagacggggacgacgaagaatctatagatttaagcaaggtcccgaatgcaacgaatgtcggcgcaggtgaagattgcacatcccccaacgacgggcgcacagagttatgccgtacgacttcggttaccggaccggcctcggtcgtgaggatgcaatacaatattatttcaccattaccgcccagctcggagggccgcgtattcgtctgtacccgttgggacgatgtcagcaataagaaggtgattgttaaagtcgtcaccggaggtagagacccagggagagaaatcgagatcgtaaagacactttcccattgcgcgattatacagctaattcatgcatatagttggaaatctacggtatgtatggtaatgcctaagtataaatgcgatctgtttacctatgtggatagaaaggaatcaatacctttgaaagacgttattgtcattgaacgacgtttgttggaagctctggtttatctgcacggcaaaggtgtaattcatcgcgatgtaaagacagaaaacatatttctggactaccccggaaacgctgttttgggagatttcggggcagcgtgcaaattagacatgcatgataatagtcccaagtgctatggttgggccggaactatggaaacaaattccccagagctcctcgcgctagatccttattgtgccaaaacagatatctggagtgccgggcttgtgttattcgagatgtctgccaaaaaaaggacactgtttggaaaacaagtaaaaacctccagttctcaactgagagcattgattagatgtttgcagatccacgctttagaatttccacaggatgaatccacgactctatgcaaacaattcaaacaatatgcaatcccactgcggcctcctttctccattccagaagttgtaagaagaaatatcccgtcaatggatgttgagtatacaattgcaaaaatgctcacatttgatcaagagtttagaccttcggctcaagacatcctggcgttccccctctttgtgaaagaagccccccaaaatctccaggccctatttgttccctgagtgctaacagcacatgcaatcgaatcccattagaagccgtgctatttaaattttaatgtcgcatagaaatatatggtatacggcgccacgcagagctctatacggcttccactttagaagccaatgttttgtcatcagtgagtaatacgacttgggttacaagagacaaacataatacgtcgaacttaacaaatgccggaatctgtacccgttttctcatcgccgctgctgcatattaacggcaggaagcccttaggtatagcctgagcgtttttacgtccactgcattgccatattcgctacatcacgtatttctacaagaagatgagagtgtctattcaacgggcaattttcctgatatacatatgtacagtctccatgtccagctcggaaaaaactcgtaatgaggacgcctctcgtattagttcttcggacacctttcgcctaaaagaattccccgtatctgcgataccatcgcctctactcgacgtagtcgataactcgtacccgacgaaacacgtcatatacactgacacttgcggtttcgctgttttgaatcccaccggcgatccgaaatacacaatcctcagcttacttttgatgggacgacatagatacgatgctactgttgcatggtacgtcctgggtaagacatgtgctagaccaatttatctacgcgtattttcagattgtcatacaaatgaacaatttgggatgtgcacttcaaaatctccgggatggtgggatattggttatgcaaaaactgcgtatattgaccgtgatgagttgacgttagtattagctgctcctgctccagagttgggtgggctatacacacgtttaatcataattaatggcgagccaatatctagtgacatacttctaacgattgaggggacgtgtagtttttcgctcaaaggcccaatcgacgaccggctctgtaaaccattcaacttttttgtaaatgggaccacgcttgacataggcatgtttcctgcacgaactccccgaccccatgaagaaaacgtaaaacagtggcttacgcgccaaagcggaaaactggatacggttattggtgaagcgtccatgcgtcatgcagcagatttgccacgtgcttttagagattcgtatttgaaatcgcctaaagataacctacctgacgaccctggaaggcctacagtttcaattagcagtatccatgccaatgatgcctatgtaggaagcacctctctgtatgaccaatcgctacgcgcaactgaagagccagtattgccatctgtagatgaggcccgtcctgcgctttatacaaatgcagagaggaaccccaggatgcaactaataatttctgccattgttgttgctagtactgtaatggtcgcactgattgggataagtgcatgtattgttaggaaatgctgtaaaaggaaaatcaaaagagggatacctcaacgcccgtccaggaaagtgtattcccgcctatgattacgtatggacttgggcgtgtcgacacagacacaaaacccagtttgcggccttcttgaaactatcgatgtaatgtctctgtcgaacgggcacatggcacattggagtgcggcgtccaaaaaacatatactatgtttcctatttcttgtcacggggagccattctctaatcttcaccgggacttcgttatccgcatcgacggatcaatcggccatcgttgccttctgtggactcgacaaaacggtgaatgtttacggtagacttttcttcttgggtgactcggttggtgttatttcttacgatggaacgacagaaattctgagatggaacgaaaaactaaagtgtttctcggtcatgtatgccgcgttgtatacggactgcccccttgcagggtctgctttatttagaggatgtagaagcgcggtggtgtatgctacccctcatgacagggtgaagccggtttccgaaaaaggattactgctgtgcatttcagatcccagaatttctgacaccggtacatattacatccgcgtgtccctcgccggcagaaatgtcagtgatattttcagaattgacgtcgttgtgacgagtagcagtattcatacatgcggccatgcggataaaggtatacaggaatgtattaggtatgccgaccgtgtgtcattcgagaactatctaattggacacgtgggacaattgctgcctgtcgactcagagctacacgccgtgtataatgtcactcccagatcggtcgttgggacaaatactgataccatgtcagcttttactaattcgacaacaaaatctgcttcgacgaatttaatcgctatgaagactactcatccaccaagtacgcggcgctgtaacttgaggcgtgcccttccaaaattaatatacatgtcttcattggcaggcctgtgccttctcgtactattaattggtagagcggttgtaaagtgcaaaacgcccaaacccaaaatctacaagggcgactccacctctgacggcatctcgcttatcaattctgcagtaaacgacgcatttgggtgtaatcctgcaaaagaggttgatccctcgaatatttctgaaggcgagaagctggaaaacatgcagaaaacgaccggaaatgtagaaaagtaaccgtgcgagttatgagctggaatggacgttacatgcgggaagaagtagggcgtaactaagtacatgttagaaggggaggggcgggttttgacttttaaaagcacaccgcgggaccacggcggaattatgcttgatatacccgggctacgtggcataatgtcttgtccgcgaatgccccttttcctaatggcggcgatgatgtgcagtgcaaccaccgtaaatcgtatactaattccccaggggaattcggcaacacttaagatctccagatatccgccggttgtagatgggactccatatacagagacgtggacatggatctctaatcgctgcaacgaaacggcgactggatacgtatgtttggacagcgttaattgttttcatgacttaatcgttaaaatggcctgttggcggtattccaaagaggtaatactgcgcactgccagattcgtggtagagaggggcgtgttaaaaacgatagagaccgctaagctgcgcaacgctccgcgtgtattgattgtggacaacgtggacactcaatggactgttttgaatgcgagcgagcaaaacgcgggcatttatattcgatattcccgaaatggaacgagaaccgctcacgtagatgccatagtccttgccgtttctggtcgaaagagaggcagggtgccaccgacagtttatcctgttggaccatttttgcacaaattccaaatctcccttaaaaattttaaaacgttcttatatcaggtgggggataccgttacaatatcgataactacacgcctggagacgacggttcgtgcgttcaagttggagtttcgggtaatgtttctcccctacagtccaaactgtaagtcgttcactatttacgagccgtgtattttccaccccaaagagccagagtgcatatctccgtcggagctatcggaatgtcggtttgcatcaaacgcgcaggtcctggaaattgccgccgcacgctcggtgaactgcagcgcgggccgcgcgtgccattacgatgccgaggtcgacgaatcgatgcagcaaaggttcgcattcctttattcggaaatcccctcgtttacaattggcaatgccgggccgggggacgcgggtctgtacgtcgtcgtcgctctgtgcgatgagcggccgacaacttggactcacgtctatctatcgaccttggacaagatcctagatgtgcacgagatcgctcacaagccgggatttgatgacagagtcttatcgagcaatgacgacgccgctcgcggtgtaagacccggagcggccatcgagaaagaatcaggtaggctccgtctaagcggagccctaattgcatcgatcgtgctggtggccgcggccgtcgtaactacggtaagcttttgcggagcttgcgtcttccggtggcgtcgcaggtgccaccggaagacgcaagctcccggcaactcttgcaagtacatgtcgttgccccaaaatcattgggaagagttttacgacgacgttagggttggcagcgcccctcagtatgagcagtttaaccaaaggttgcccgagagaacgagatcaggctacaccgcttggctctcgtctgatatagccgccgtaagaaagcgtctcgattgaaatcgccgagacgtgcgtgccgattgttgtttttattgtatcgcccgtacttaacggtcctttatccccgcgcgaaataaaactgtccgactcagtctactggtgctcgcgtttacctccactgcgtaccgcgcgccaattttcgtgtaggtgtgcgtatggtggagtggtttgggggaccctgtctctaagccggcacactccacgctatttccccccgcccggtgggcacaagcgcttgcgggaggaaccagttgtcggttttttatgcgggctcctcagcaccttcgccacccacccacactccgcgccccgactgcgcgaagctgccccgtttaggcaaacggggcccggccggcgcgacgcagaagaataaagcagactccgtcgtttcttctataatggagggtatactcgtttattgcgacatcacaccccgtgttgctattttaaattgaaggccgttgataacccgcatcatccactaacgtcgttagcgataacgattgtatcttcccccccccccccacctacggtttgtcgacagctatgataagcggaggaaaacctgcctgattccttgggcggggatccttgtgcgctgtcttgctctgtatgcgccgacccaaagccgcctcctcctcaacgtaaatttaaccgcccaggccgcgtagttgcgtgtcctgaacgggaaagaagttcgttcgctgttattgtggtcattaccgtaactgtcccggcgtgcctccatctgctgagtcccgtgcagactggcatgaggatggttgttcggcggcaggcaactcccccctcatccctactaatcccgaatgcctttaatgatcacgcaataacccctcctcttaacaatatctctttttcgatgaagatttcagttcccccataacacggcagaacgagtctgatccctgatcaattggaacgacttccttcttcagaaaggttaaacgaggacacagtctgcgacgagagggcttaacacttcctcctgtgcgagagcgcgtctctgcgatgtggcttcgccgcaaagtcctttcccatactaggcgtaaaccgcactataacaactccccctccccccagcacccaaggggcccgtgaaaccgcgactggtttcttcttcactggctcagtactgcaaatgtgctgcttacctcgtgattgctgtcgtcggggctcgttcgcactttccaggccaccaaagaaagcgagaccagagccaatcgggaccatctccgaaccttgttcgctaccacacacgtgccgccctttgttgacgtggccgcaaacagagctcgtggccacgccaacgaactgctcgtcctataaaacccctcccatactcaatgccccctgaaatgtttgcaggggggaaagtgaagccttctgcttcattcaggtgttcgcaatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacatttccccctccctatcgttagggactcaacggtctgtccatctacccaggtgcacaccaatgtggtgaatggtaaaatggcgtttatttgatggtggcaacagcttatataatcgtgcatagcttcgtctacgcccatatgtccttgcgtcattccttccttatctagttgccaccaatgagcatatggaatgtcttgctttttccttatttggtctttagactattcaagttgcctctggctctatttgactacaggaaagggagacgtgaccgcggccgtctctcccggctagctccgagccgaatcgagaaggggctgccgccggcaccgcgctcctggtaggtgctgtcgggtcgcgcgatcgcgtggacgccggtgcgttaggggcaagtagggccggccccccctcccccacgcagcgcctattgccccgtcgcctctctttgtccctgaccccgacgcgaatatcggggggggggggggcggcgcgggtcggggaaagaggtgggacgtgttggcgtgagcgttgggtgcttaataattcgctctgtccggccgtcggtatttctctcccaccaccaccccctccatttctctcctcttctgtctccaaccaccaccgccccctccgtttctctcctcttctgtctccaaccaccaccaccccctccgtttctctcctcttctgtctccaaccaccaccaccccctccgtttctctcctcttctgtctccaaccaccaccaccacccccccccccccccccaaaaaaaagaaatacacgcgcgcgcttgactttttagagccgggcggttcgcccgagcctaagcgtctcgatgctcaagggccggtccgcttcgggttctagcccccgggcgagcactctcccgagggcggtaggaacgtcgggagcgagagaaacaaaccgcacgaaccgcacagtcgctcgcaggagcgtgtcgagggttaatgtctccttacctcggcgtcgctaggagaatgtttgcccccggggagcctagcagcgctgaccgcagcatatctaatggcaaaacctgctcgtttcgcaatccggccgataagcgtttgtttgacaagaaacgttgtgggcggcggaatgtttacctatggggctcggctgattcggagagcagcccggggatcaaatcgcgttgatgggagttaatgattaaaggagtagccaggccggcactgccggagccgtggctgtggtgtgtgtaggggcggggtggtggtggtgttgggcggggggcaagaagcgatgcgaactgcggggaacgctttctcacggttccccctcatttttttcagagcaggactccttccgcgctccctgcgctggtccccatccgcccgattaacccctgcatttacgcccctgtaaggagcggatcgccagtgctgccggcgtcgccacggttggaccggcgcgcgtttcccccattgctcggacatggagaacccgcccgatttctacagcctgttagagatgttagccgacaacggcggattttctccgcagccacccgccaccccgggagatccgtaccaggacgtgtgcttgaatacaccgagcgtggccgtgcccccgacgcccggtcggcagcccgtcccgccacggtctaaatcccctgcccgcgcggctcccgtcgcgggcagccttgccggcgcacgagcccctttcggcattgagggtgccgtttcggagggttcggatacgggtctccgttccgccgaaccccccgacggcgcgcatcaggggtctcctggcgaggtcgtcagttccaccgcggacatcgtggacgtctgtggaaacgaaacggccgcggcggccccgcggtcctgttcttggcaaaagacagtcggcgatctagtccccgcgggttcggaacggggcgaaccgagccctatggatccccgcaaatcaaacgaccccgtccgctgcgtatctgacgcgccctgtaagcccaccggcgcctgcacgccgctcgccgtctgtgtcgaaactctcccccctccctcgggcgtgccccccccacccccccccgaacctatcgtgaacttcccatggacattttctccgctgacgccgggaccgttcgctcaacaccattcacccactccccctacaccacctccccttagcccccctcctcctacgccacccccccttagcccccctcctcctacgccacctccccttagcccccctcctcctacgccacctccgcataccccccctccgcacggttcccctccccccacgcctctgccgtctacctcccctccctctacgcagacatcctccccgtctgcgtctctaccgcttgactcgcctccggcgtctaccccacctccgccaacccctctccacgacaggcctctttccccggaccccccagccctctctgcttcttgtcagcgtccttcccctccgttgtccccttcagccccccgcctcgcacccgctcccctccggagcgaccgagtcccagcccgccgtaaatcgagcgtttccgagggcgggggcccccgtaccaggggcgcgggcttccagtacgtctgccgcctatccgcatccgccaggatcccatccccccctcgagaagagctcgagttggtggcccgccagccggggagccacgctatgttgtggcgcgcgggggctcgcgacggcgcgacggagccgtcctccggagacaaccctaaggtttttctcctcgcgttgtcggacgctcgccggtgcccttcctactgggatcggctggcgagggaagcggtactcagagaaatcttacctactccgcgcggcagccctctgcggacctcaccggggtctatcgaactgccgagagaggcccctttactcgacagcgactaccggccgttcgaatggcgttgcgcgaagggtcgcccgctgccccaggagccggtcttcccgtgccctccgaacgagctggggaatgactgggcggcctgcaagatgtggttgttttctcgatgcgcgcgcctcgttctctcgaccctggacgatatgtcgccgtccgaggacggggaaagcgtgttagaatcgcagggttgcggatggggcccgcagaacgagtgcccgctccccctccccgccccgatagtgctgccaacgcgcatctgggaagcggtaacacggctcccgagaccggctccgcgcaccccgacgtacgcttacattttgtcggcgctccttcgcttcctcggccttcaagtcacccccgatttcgtgtcgaaggttccccgcctttcataccgctggctggaccgactccgctgcgtcaggcgcgtccagtacatggcccacgttctgacacgcgacttttcctatcaattacaagcggctcgtggtctgccgtgctttccggcgtgcgcgccgccgccgggcgcgggtactcccttggacgaggactggaacggaacgccgccctctgaatccccccgcggtctcgactgcagccggcgccgcggcggcttctatgcctccaacttctgtcctctgctcgaggagattcggtgggtggaaggccgggaaggcagcccgaacccctggaccgggctcacctggaacgatttcaagatgctacattacaggtgtctttttttcaaagtgcgtcgggggttactgctggccccagacgactacatcgtcggccccgacgtgcggcccggcttcgaggtgcctttcgaaatgccccccccgcccgccaccgcgctccctcccgcgctttccgcggccgtcagggaatcgaagttggcgctgcggaacggaaatccggaacccggcgggacgccccacggctctcgtcccgcacgcgcctacggattcatggtgcagcagctcgccgtcgctatggtcgaactggggttccccgcctgcggtccggccatcgaaaaacgggtcagacctctgtacaaagccatacttgattggcgcgccgccgtcaccgccgcggcgctacgccgattcagacacctccgtcagccgtccggcgcgagggacgacggagcgcccatgtttcccccccttcccgttccagactggaacgggccgtctccgaggccgggcctcgttagcagccccaccggtacgcaggaacgttaccgcagagtccagccgggatcgggctccgatggttcgcacacaacagctccacctgctgttctaaaacaggcattacaacaggaggttggcacgccggcgacccgcgcttcccatcccctaccccggcctcccccggcctcgtacccttcgctcgggtgtcgctccagatcttcctcctcctcgtccgcttcctcttcctcgtcctcttcgtcgtccgcgccctcttcatcggaacagtcgtctgccgccccttcttcgcgcacctcatccaggtcgccgacccgcgaggcaggagcgcctcaatgcgctgccagaggccgcggccgcggccgcggaggacggcgcggccgcggccggcgggcgccatcaccgtcctcggaaactgctgcgccgccaccgccggatgacctcgaccaagaggtgtggtggcaaattccctccccgccggccggccggtgctggttcgggcctctcggcggacaccgacaggcgctccggggcatccctgaagtagagcaggccgccgttagattcctctctactcccggtcccctcccggtgtacgtggaggaaatggggaactgcgccaaacagtacgaggcgctcgtaagcgccatgcttaacaaagacgtgaaggcgaaccccctgaactgggcacaccacggcaagctctcgcccaccgacgcagcgctcaatcacatctatgtcacgaagtttcagagctcgcacagttcgccgggcgcggccgtcacggggacggtcaacaaatgcataccccacatagccagcgccatgaagaagcgaaatctgctttgggcgctaccgcacatcgccgccagcgtgtctatgactcgcaggtactgcaaagatcagaaagagttcatgttccgctccctcaggaaagcctacgcgcctatggcgtctgcagccagcgccgaaatgcgacgcccctcggcatcgcctatttcaaatcgggcacccgtcactgcccaaagtacggcggccgggctcatcccggtaatagacgtgtccacgatccacgaccgcgtgcgccggggcgtcgcggccttcaattccgcgctagaggagggcctgctggacgtccccgaataccgattggtcgcgcccgcgcgtccggacatccctgccggggacggtttcgcgtctacccggccgctgaacgagctggtggacgcttgcgcgctggagtgcgagggggtcgtggcggcgcttctgcgcggacccgacggtccgggcgcggtcgcggaaatgctgtcgtcttgcgaggacgggcccttccctcgacccgccggccacgaacagtgggaaaaatgccgggctctgctcgggtcgtggctccgagacctgcttgatctcaggagcgccgtgtacgcggcctacgcgaacggttcggctcctcgggggcgccaggagcgaactctcgcggctaatgcggtggccctgataacggaagcgatcggcccgttgcttagcaaagaccccgctcggccttggcgatgccctgggtcgagggacattacttccgtgctcctgcgcgaatgtgggtcgaggggcgaaccggtacgatcccgcgagaaggcccgacggctgcaacgcgtggcgcgccttctcgcggacgccgacgcggcctcttccggaacgtccgagggccggtcgcgctccgcggagccttgttacgaccccggccccgcaagttctcccgagcccgtgcgggccctttgcgcccaaacgtcagccgagtcaaggaagagaaaatcagctcccgcggcggttctcgacggcgcggacaacgccgtcgagaacccgcgtccgcgtttgggaaggtcccggacaggcgccggacctccgcctgtcgccagctgcacaaggccccccaccccccctgaagcgtgccgcgacgccgggcctttcccgcccaagcgcccacgttgctttccgtggcgcgaccccgcgcgcattatggacggttccctgtcgttaggcgatcgacggcatcgtggcgccgcctttaggaagccccccattggaactccgattgctggctatgccggccccccgcacctcgacgcctattgtccaggcgaaggagtcgacgagctgaccagcttcgcccaaataccgactctgtggcgtcagccgttggcgcgttctccggaggccatggcggagatcgctcgcgtggcgagcactccctcgcacgtcagcagaagcccagacactgctgcgtccgagggagtgttgtgccgcacggccgtcgtctctctcagagcgcgcaccgcttggatgcggcatcagcaggcttcgcctgaagatgtcgctctcgtcatcctgtacacggccaacccaggcgagcacctgttttgcgtaccggcgcccggctcgccccccgggggaccccggttcgacccgaaccggggaggactctctttcctgctcgccgcactcgccaaccgcctctgcctaccggagagcgccgcctgggcgggccggtggagagcggcgccggacgtttcggcgctgaccgcggccggcgtcatgttcctgtcccctcaggacctcggttttgcgggcgtcctggaacacctgcaacgcctctgtttgaaacgagaaaaaaggctcgtggtcctggacacgctagaggatcaagatcgcccggagaacggcccgcgcctcgtggaagaagccgtccgctacgtcaggtgcaccgtctcgccccgcagccaatgctccgtccgatggcctggccaccccgatctagctacgacggtcataacctcgcgggacgtgctgggccccgtggtcctacgtgagctggaaacgcactttcgccgcgaaaaccccgcggccggcgacatcagtctgtgctgcggaagcaacgtccgatacaaggtcgcgacgcgactggaccgcgtcgcgacggtcccaatgaccgctctctcctacctcgcagcctcctcggcccttgtggccgggcgccagaggccgcccggccccgactttttagctggagagtcgcactcccaccgagccgctctcaagtggggactgtacgccccgctgcgtcccgtgtacgtcttggagcccaaaaagaacgccatagtttcccccgatttcttaaataggaccgtctgcgacgtttgccgctccgtagtcctcccccccgatccgcacgcccagccagtcgtcgttcacgttcccgaagcgacgtgcagtttattggcccgcgagatgctcgctcacctacgtagctcgtctgtagtgtggctggaaggggacggcggtccgccggagaccaccgtccaggaggaacagggcgcgcgacagaggataattcatcctccgacgctgcccggtcctccttcgcccttggccctcagcgactctgaagtcttcggcgagtgaaggctaagtcagggtcgggggggggggggcggggggagtcactcggcggacttttaagggctatctggacaagcagccccgcgggtacgacatatcatccgcgagcggggagacggacaaataaattagggggccagcggaaccccgcggctcggttgcgttccgcgctgttagtcgtacgggccgcggtctgccgtgcggatgcgtcaccgcctggtccattggtcggccgtggccacgcctctatacctgttcccagaacgaatgccccgcgcgcaccttcgcccggccattcagtagcgcagaagcgccggcgagcccgcgggcgcgttcgccgtagtgttctcccgcaaacgcggtagagaaagtttcgtaaaaggaagaccgcgcggcgacagcgcctagaagacccgtggcctgtacgaggaggagcggcggcgaaagcggggtcctttcgccctgcgctccgccaaaggggggaggggacggacaatggagcctcccacggcaaagtcggacggggccgcaccggatcccgacggcgacgtgaaccgaaccgacccgccgctcattgtccctcaagcctcagaactccgccctaccttctccgaaagctcccgggggtccccgacggcggtctgcccgggaaccgaaaccgcgggcgcggagccgtggccccctggactcagatcgccgcgtcctttccgaaggcctgcgcggctgtaccgaagaatcgcgatccctagggctgcggaaaccgctcctccggatcctgcaacgagctccgctccgtgaaggtcatctcgaacggatagaaccgctcaaggtcgggggggggggggggggtggtggtagggttaacggtagctgggattgagatgtagcgctggcgaataaataaataaataaatgaatgaatgaatgaatgaatgaatgaatgaatgaatgaagggaccagatgcgacagacatcattcgcgctctctgaccgactcttgccggcggcggcagggggtttcggtcgccctgggtggccgggggggggggggcggggggtgcgtccggaggcagcggcgcgcggggacacctctgttcttacgctgttcgcggagagccctctaccccgcggatcgatccctcgcgcgggagcaatctctgcggtcccctgcgcagcccgcggagcggttcggtccgcggcgcgctcgcccgctcgcccgcccggctatcctcttccgcagcggcaccagaaagtggcgggaacgagcgcgcatacgggagacataaaaatggcgggggagacgggtttctgatcgagtcggcgagcgggcccgaggaaagcggcagcgggacagggtttccggatcggaccgcggcggctaccgaggcccgctgtcgcactccgcggtccctaattgttcgcccgcgcacccccctcccccaccccattcgcgtcggcgagcgggcccgaagaaagcgcaggggggacacggtttccggatcggaccgcggcggctaccgagtccacctcgcgccccccgcggaccccaatcgttcgcccgtgacggtctctggactgttctgcccctccccctttcccccaccacccacgccgcagacctttttcgagacgaaccgcggctgtcctaagtgaccgagacgggcgcctgaaaaagccttgcgtctgatcggggggggggggggggcgcgactccaagcgttagaccgccgaccgccggcggctccgcgcggccagtaggccgagccgcacgctgcatccccgccggacatgcccgccggccgcgcgggcgctcgctaggccgcccggaaatgcgtagcggacccgtgcgcgcatgcgcgcagtcgacatttgcgagcatgcgcgcggcggaccctagcgagcatgcgcgcggcggaccgtagggagcatgcgcgcggcggaccgtagggagcatgcgcgcggcggaccctggccaccaccaaacgtcataccaaaactctcgcggcggcgaactgaataaaaaaaattcaccctaaccctaaccctaaaggcctaaccctaaccctaaaggcctaaccctaaccctaacggcctaaccctaaccctaaccctaaccctaaccctaaccctaaccctaaccctaaccctaaccctaaccctaaccctaaccctaaccctaaccaacttaatatccccccctgcatttcaccccccccccaaaaaaggaacatagcacaacaattaacgcggct

What is claimed is:

1. A recombinant *Gallid alphaherpesvirus* 3 (GaHV-3; MDV-2) virus that expresses a heterologous polynucleotide encoding and expressing a gene or antigen from an avian pathogen, inserted into the UL45/UL46 intergenic region and the US2 gene regions of *Gallid alphaherpesvirus* 3 (GaHV-3; MDV-2).

2. The recombinant virus of *Gallid alphaherpesvirus* 3 (GaHV-3; MDV-2) according to claim 1, further characterized in that the *Gallid alphaherpesvirus* 3 (GaHV-3; MDV-2) is selected from the non-oncogenic strains: SB-1, 301B/1, and HPRS-24.

3. The recombinant *Gallid alphaherpesvirus* 3 (GaHV-3; MDV-2) virus according to claim 1, characterized in that the heterologous polynucleotide sequences that can be inserted into the *Gallid alphaherpesvirus* 3 (GaHV-3; MDV-2) genome are: (i) fusion gene (F) (SEQ. ID. NO. 3) of Newcastle disease virus (NDV) genotype XII, or at least another hemagglutinin neuraminidase (HN) gene, (ii) glycoproteins D and I (gD-I) (SEQ. ID. NO. 20) of avian infectious laryngotracheitis (ILTV) or at least one gene of the following genes gB, gE, and gC, (iii) the VP2 protein (SEQ. ID. NO. 34) of Gumboro infectious disease (IBDV) or at least one gene of the following genes VP3, VP4 of IBDV, (iv) the hemagglutinin (HA) and neuraminidase (NA) genes of H5N1, H5N9, avian influenza (AIV), avian infectious bronchitis (IBV) at least one Spike (S) gene, S1, and S2.

4. The recombinant virus of *Gallid alphaherpesvirus* 3 (GaHV-3; MDV-2), expressing the fusion gene (F) of NDV genotype XII, the glycoproteins D and I of ILT, according to claim 1, characterized in that the insertion of the NDV F gene and glycoproteins D and I of ILT, is inserted into the non-coding intergenic region between UL45/46 of the genome of *Gallid alphaherpesvirus* 3, which has SEQ ID NO. 2.

5. The recombinant virus of *Gallid alphaherpesvirus* 3 (GaHV-3; MDV-2), which expresses the gene of the IBDV VP2 protein, according to claim 1, characterized in that the insertion of the IBDV VP2 gene is inserted into the non-essential US2 gene region for the genome of *Gallid alphaherpesvirus* 3 (GaHV-3; MDV-2), which has SEQ ID NO. 33.

6. The recombinant *Gallid alphaherpesvirus* 3 virus (GaHV-3; MDV-2) expressing the fusion gene (F) of the Newcastle disease virus (NDV) genotype XII according to claim 3, characterized in that the cleavage site or polybasic cut ($^{112}$RRQKRF$^{117}$) is modified to dibasic ($^{112}$GRQGRL$^{117}$).

7. The recombinant *Gallid alphaherpesvirus* 3 (GaHV3; MDV-2) virus expressing the fusion gene (F) of Newcastle disease virus (NDV) genotype XII according to claim 1, characterized in that the synthetic sequence of the F cassette (genotype XII) is stored in the plasmid pUC57-F, the sequence of the F cassette and HN of NDV.

8. An immunogenic composition characterized in that it comprises the recombinant virus of *Gallid alphaherpesvirus* 3 (GaHV3; MDV-2), which expresses the F gene of NDV genotype XII identified with SEQ ID NO. 5 and pharmaceutically acceptable excipients.

9. An immunogenic composition characterized in that it comprises the recombinant *Gallid alphaherpesvirus* 3 virus (GaHV3; MDV-2), which expresses glycoproteins D and I of ILTV strain VFAR-043 identified with SEQ ID NO.22 and pharmaceutically acceptable excipients.

10. An immunogenic composition characterized in that it comprises the recombinant *Gallid alphaherpesvirus* 3 virus (GaHV3; MDV-2), which expresses the VP2 gene of IBDV strain Faragher 52/70, identified with SEQ ID NO.36 and pharmaceutically acceptable excipients.

11. A procedure for generating a recombinant virus of *Gallid alphaherpesvirus* 3 (GaHV3; MDV-2), expressing antigenic genes against different avian diseases NDV, ILTV, IBDV, IBV, AIV, wherein the method comprises:

a) Design and construction of gRNAs and donor plasmid;
b) Generation of recombinants;
c) Recovery of recombinant viruses;
e) Selection and characterization of recombinant viruses containing the GFP cassette+the cassette of interest (protective antigen), by conventional PCR amplifying the complete inserted cassette and the joining zones between the genome of the recombinant virus obtained and the genome of the modified virus itself,
f) Removal of the expression cassette of the fluorescent reporter gene "GFP" by the Cre-Lox system and selection of recombinant clones using conventional PCR;

g) Detection of expression of proteins of interest in cells infected with recombinant viruses by indirect immunofluorescence (IIF);

h) Determination of gene expression by Western blot (WB);

i) Evaluation of genetic stability of the cassette inserted into the virus genome by conventional PCR and/or Western blot (WB); and j) Measure in vitro growth properties.

12. A kit comprising a vaccine or immunogenic composition according to claim 3 and a medium.

13. An immunogenic composition comprising a recombinant *Gallid alphaherpesvirus* 3 (GaHV-3; MDV-2) virus according to claim 3, further characterized in that the concentration of virus required to achieve the antigenic response is 3000 plaque forming units per bird (PFU/bird).

14. A viral vector comprising a recombinant *Gallid alphaherpesvirus* 3 (GaHV-3; MDV-2) virus according to claim 3, useful in the control against Newcastle disease virus (NDV), against infectious bursal disease virus or Gumboro (IBDV), against avian infectious bronchitis virus (IBV), against avian infectious laryngotracheitis virus (ILTV) and against avian influenza virus (AIV).

15. An immunogenic composition comprising the recombinant *Gallid alphaherpesvirus* 3 (GaHV-3; MDV-2) virus according to claim 3, further characterized in that the *Gallid alphaherpesvirus* 3 (GaHV3; MDV-2), is selected from the non-oncogenic strains: SB-1, 301B/1, and HPRS-24.

* * * * *